United States Patent
Anand et al.

(10) Patent No.: US 12,378,565 B2
(45) Date of Patent: Aug. 5, 2025

(54) METHODS AND COMPOSITIONS FOR HOMOLOGY DIRECTED REPAIR OF DOUBLE STRAND BREAKS IN PLANT CELL GENOMES

(71) Applicant: PIONEER HI-BRED INTERNATIONAL, INC., Johnston, IA (US)

(72) Inventors: Ajith Anand, West Des Monies, IA (US); William James Gordon-Kamm, Urbandale, IA (US); Sandeep Kumar, Johnston, IA (US); Zhan-Bin Liu, Clive, IA (US); Sergi Svitashev, Johnston, IA (US)

(73) Assignee: PIONEER HI-BRED INTERNATIONAL, INC., IA (US)

( * ) Notice: Subject to any disclaimer, the term of this patent is extended or adjusted under 35 U.S.C. 154(b) by 342 days.

(21) Appl. No.: 17/053,663

(22) PCT Filed: May 7, 2019

(86) PCT No.: PCT/US2019/031017
§ 371 (c)(1),
(2) Date: Nov. 6, 2020

(87) PCT Pub. No.: WO2019/217354
PCT Pub. Date: Nov. 14, 2019

(65) Prior Publication Data
US 2021/0238614 A1    Aug. 5, 2021

Related U.S. Application Data

(60) Provisional application No. 62/751,845, filed on Oct. 29, 2018, provisional application No. 62/667,968, filed on May 7, 2018.

(51) Int. Cl.
C12N 15/82 (2006.01)
C12N 9/22 (2006.01)
C12N 15/11 (2006.01)
C12N 15/90 (2006.01)

(52) U.S. Cl.
CPC .......... *C12N 15/8213* (2013.01); *C12N 9/22* (2013.01); *C12N 15/111* (2013.01); *C12N 15/902* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| | | | |
|---|---|---|---|
| 2013/0157369 A1 | 6/2013 | Miller | |
| 2013/0263324 A1 | 10/2013 | Lassner et al. | |
| 2014/0090113 A1 | 3/2014 | Cogan et al. | |
| 2014/0335063 A1 | 11/2014 | Cannon et al. | |
| 2015/0082478 A1* | 3/2015 | Cigan | C12N 15/63 800/300 |

FOREIGN PATENT DOCUMENTS

| | | |
|---|---|---|
| WO | WO2007/092308 A2 | 8/2007 |
| WO | WO2013/160230 A1 | 10/2013 |
| WO | WO2016/025759 A1 | 2/2016 |
| WO | 2016040030 A1 | 3/2016 |
| WO | 2017070032 A1 | 4/2017 |
| WO | 2017132239 A1 | 8/2017 |

OTHER PUBLICATIONS

Zhang et al 2017 (Genome Biology 18:35, p. 1-18) (Year: 2017).*
Zhang et al 2017 (Genome Biology 18:35) (Year: 2017).*
Lowe et al 2016 (The Plant cell 28: p. 1998-2015) (Year: 2016).*
Zhang J, et al. "Efficient precise knockin with a double cut HDR donor after CRISPR/Cas9-mediated double-stranded DNA cleavage." Genome biology 18.1 (2017): 1-18.
Chu, V, et al. "Increasing the efficiency of homology-directed repair for CRISPR-Cas9-induced precise gene editing in mammalian cells." Nature biotechnology 33.5 (2015): 543-548.
Nakajima, K, et al. "Precise and efficient nucleotide substitution near genomic nick via noncanonical homology-directed repair." Genome research 28.2 (2018): 223-230.
Supplementary Search Report. Ref N420455EP. Date of Mar. 22, 2022.
International Search Report and Written Opinion for PCT/US2019/031017 mailed Jul. 25, 2019.

\* cited by examiner

*Primary Examiner* — Matthew R Keogh

(57) ABSTRACT

Methods and compositions are provided for the improvement of homology-directed repair of a double strand break in a plant cell, via the use of a polynucleotide comprising sequences homologous to the target site. In some aspects, the double strand break is created by an RNA-guided Cas endonuclease. The homology-directed repair of the double-strand break may include incorporation of a heterologous polynucleotide, for example a gene encoding a trait of agronomic importance. The homology-directed repair of the double-strand break may occur as a result of template-directed repair using a polynucleotide repair template.

10 Claims, 54 Drawing Sheets

Specification includes a Sequence Listing.

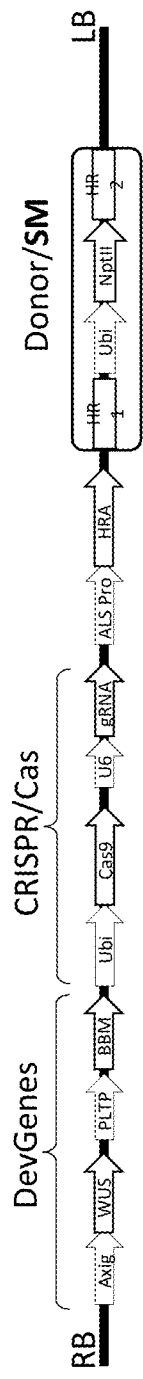
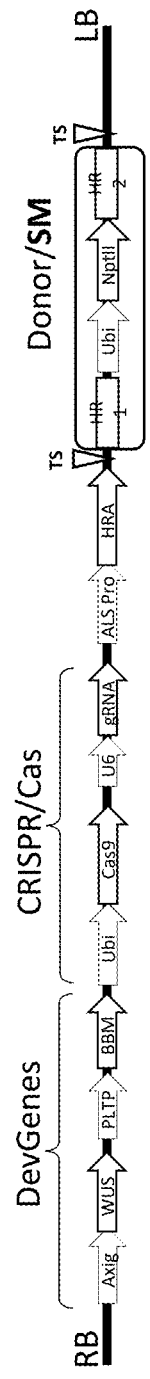
FIG. 1A
FIG. 1B

Junction qPCR

Long genomic PCR

Donor DNA Cassette

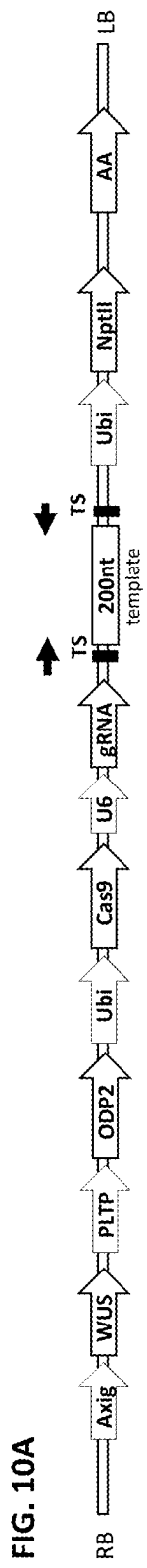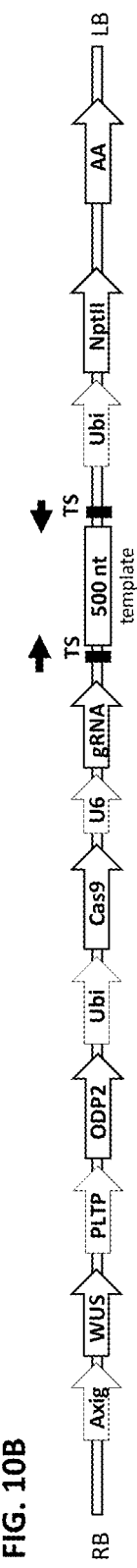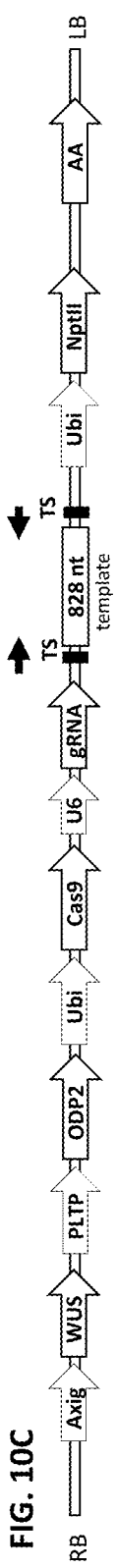
FIG. 10A
FIG. 10B
FIG. 10C
FIG. 10D
GTCCATGGTGCATAATGAGGGTAGTGGATGATGAGCAATCATTGT    SEQ ID NO:70

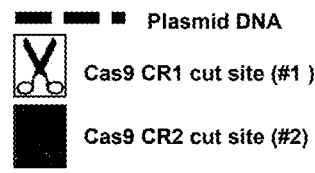
FIG. 18A
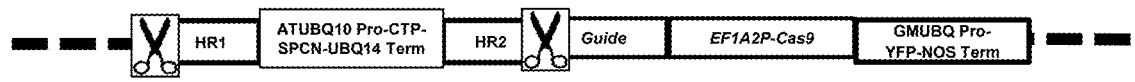
FIG. 18B
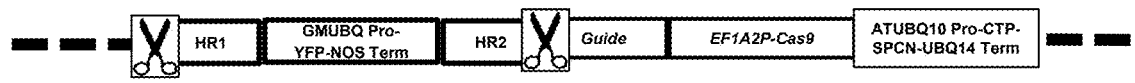
FIG. 18C
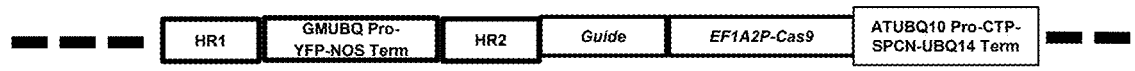

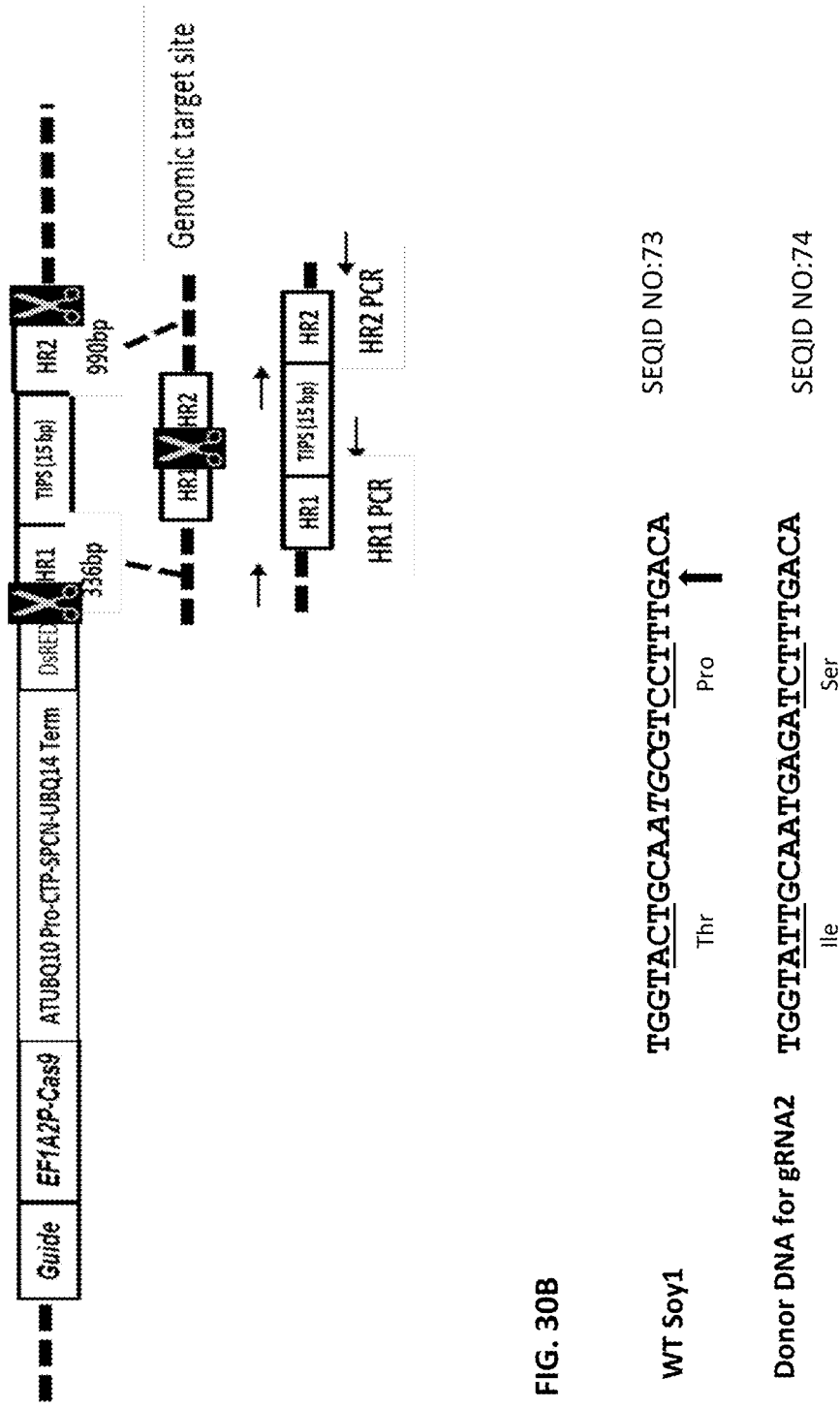

FIG. 30C

```
       480
      ..|....|
     TAYTG
     =========
     TATTG
     TATTG
     TATTG
     TATTG
     TACTG
     TACTG
     TACTG
     TATTG
     tactg
     tattg
     tactg
     TATTG
     TATTG
     TACTG
     TATTG
     TACTG
     TACTG
     .....
     .....
     .....
     .........
```

FIG. 30D

```
        490
       ..|....|
      GMGWYCT
      ==========
      GAGATCT
      GAGATC▶
      GAGATCT
      GAGATCT
      GCGtCCT
      GCGTCCT
      GCGTCCT
      GAGATCT
      gcgtcct
      gagatct
      gcgtcct
      GAGATCT
      GAGATCT
      GCGTCT
      GAGATCT
      GCGTCCT
      GCGTCCT
      .......
      .......
      .......
      .........
```

METHODS AND COMPOSITIONS FOR HOMOLOGY DIRECTED REPAIR OF DOUBLE STRAND BREAKS IN PLANT CELL GENOMES

CROSS-REFERENCE TO RELATED APPLICATIONS

This application is a 371 National Stage Entry of PCT Application Serial No. PCT/US2019/031017 filed on 7 May 2019, which claims the benefit of U.S. Provisional Patent Application Ser. No. 62/667,968 filed 7 May 2018 and U.S. Provisional Patent Application Ser. No. 62/751,845 filed 29 Oct. 2018, all of which are herein incorporated by reference in their entireties.

REFERENCE TO SEQUENCE LISTING SUBMITTED ELECTRONICALLY

The official copy of the sequence listing is submitted electronically via EFS-Web as an ASCII formatted sequence listing with a file named 7781USPCT_SequenceListing_ST25.txt created on 15 Oct. 2020 and having a size of 1,009,287 bytes and is filed concurrently with the specification. The sequence listing comprised in this ASCII formatted document is part of the specification and is herein incorporated by reference in its entirety.

FIELD OF THE INVENTION

The disclosure relates to the field of molecular biology, in particular to compositions and methods for modifying the genome of a cell.

BACKGROUND

Recombinant DNA technology has made it possible to insert DNA sequences at targeted genomic locations and/or modify specific endogenous chromosomal sequences. Site-specific integration techniques, which employ site-specific recombination systems, as well as other types of recombination technologies, have been used to generate targeted insertions of genes of interest in a variety of organism. Genome-editing techniques such as designer zinc finger nucleases (ZFNs), transcription activator-like effector nucleases (TALENs), or homing meganucleases, are available for producing targeted genome perturbations, but these systems tend to have low specificity and employ designed nucleases that need to be redesigned for each target site, which renders them costly and time-consuming to prepare.

Newer technologies utilizing archaeal or bacterial adaptive immunity systems have been identified, called CRISPR (Clustered Regularly Interspaced Short Palindromic Repeats), which comprise different domains of effector proteins that encompass a variety of activities (DNA recognition, binding, and optionally cleavage).

There remains a need for methods and compositions for the improving the frequency of homology-directed repair of double-strand-break sites.

SUMMARY OF INVENTION

Methods and compositions are provided for improving homology-directed repair of a double-strand-break (DSB) at a target site sequence, by providing a heterologous polynucleotide, comprising a donor DNA or a polynucleotide modification template, which is flanked by target sites that are capable of being recognized and cleaved by a double-strand-break-inducing agent.

In some embodiments, the DSB agent may be any endonuclease, such as, but not limited to, for example, a Cas endonuclease, a meganuclease, a TAL-effector nuclease (TALEN), or a Zinc Finger nuclease. In some aspects, more than one DSB is created in a polynucleotide, either concurrently or sequentially, wherein the DSB agent is the same for a plurality of DSBs. In some aspects, two or more different DSB agents can be used. Different DSB agents may be of different molecular types (e.g., a Cas endonuclease and a TALEN), or may be of similar molecular types with different components (e.g., a Cas endonuclease that complexes with different guide polynucleotides to recognize, bind, to, and cleave different nucleotide sequences).

In some embodiments, the heterologous polynucleotide becomes incorporated into the target site. In some aspects, the heterologous polynucleotide provides template-directed repair of the target site.

In some embodiments, a morphogenic factor is further provided. In some aspects, the morphogenic factor is BBM, ODP, or WUS.

The compositions may be provided as part of a recombinant construct, which may be introduced to the target site sequence via any method known in the art. In some embodiments, a cell comprises the target site sequence. In some embodiments, the cell is a plant cell.

In any of the compositions or methods provided herein, a plant cell may be obtained, or derived from, a monocot plant or a dicot plant. In some embodiments, the plant cell is obtained or derived from a plant selected from the group consisting of: corn (*Zea mays*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), wheat (*Triticum* species, for example *Triticum aestivum, Triticum monococcum*), sugarcane (*Saccharum* spp.), oats (*Avena*), barley (*Hordeum*), switchgrass (*Panicum virgatum*), pineapple (*Ananas comosus*), banana (*Musa* spp.), palm, ornamentals, turfgrasses, an other grasses, soybean (*Glycine max*), Brassica species (for example but not limited to: oilseed rape or Canola) (*Brassica napus, B. campestris, Brassica rapa, Brassica. juncea*), alfalfa (*Medicago sativa*),), tobacco (*Nicotiana tabacum*), Arabidopsis (*Arabidopsis thaliana*), sunflower (*Helianthus annuus*), cotton (*Gossypium arboreum, Gossypium barbadense*), peanut (*Arachis hypogaea*), tomato (*Solanum lycopersicum*), potato (*Solanum tuberosum*), safflower (*Carthamus tinctorius*), sweet potato (*Ipomoea batatus*), cassava (*Manihot esculenta*), coffee (*Coffea* spp.), coconut (*Cocos nucifera*), citrus trees (Citrus spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), vegetables, ornamentals, conifers, vegetables (for example, but not limited to: tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*)), and ornamentals (such as, but not limited to: azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and *chrysanthemum*)).

Any of the compositions disclosed herein may be introduced to a cell comprising a target site sequence via any method known in the art, including particle gun bombardment and bacterial-mediated transformation (e.g., *Agrobacterium* or *Ochrobactrum*). For bacterial-mediated transformation, a helper plasmid may further be provided. In some embodiments, the helper plasmid is a superbinary vector. In some aspects, the superbinary vector is pVIR7, pVIR9, or pVIR10.

In some embodiments, the recombinant construct further comprises a selectable marker gene. In some aspects, the selectable marker gene is part of the donor DNA cassette. In some aspects, the selectable marker gene is outside of the donor DNA cassette.

The double-strand-break-inducing agent may be any known in the art, including an endonuclease such as a Cas endonuclease, meganuclease, zinc-finger nuclease, TAL-endonuclease, or a restriction endonuclease.

For any of the methods provided herein, a trait of interest may be modulated in a plant cell as a result of the homology-directed repair of a genomic double-strand break target site. For example, the trait of interest may be selected from the group consisting of: selectable marker resistance, disease resistance, drought tolerance, heat tolerance, cold tolerance, salinity tolerance, metal tolerance, herbicide tolerance, improved water use efficiency, improved nitrogen utilization, improved nitrogen fixation, pest resistance, herbivore resistance, pathogen resistance, yield improvement, health enhancement, vigor improvement, growth improvement, photosynthetic capability improvement, nutrition enhancement, altered protein composition, altered oil composition, increased biomass, increased shoot length, increased root length, improved root architecture, modulation of a metabolite, modulation of the proteome, increased seed weight, altered seed carbohydrate composition, altered seed oil composition, altered seed protein composition, altered seed nutrient composition, improved fertility, improved fecundity, improved environmental tolerance, improved vigor, improved disease resistance, improved disease tolerance, improved tolerance to a heterologous molecule, improved fitness, improved physical characteristic, greater mass, increased production of a biochemical molecule, decreased production of a biochemical molecule, upregulation of a gene, downregulation of a gene, upregulation of a biochemical pathway, downregulation of a biochemical pathway, stimulation of cell reproduction, and suppression of cell reproduction

BRIEF DESCRIPTION OF THE DRAWINGS AND THE SEQUENCE LISTING

The disclosure can be more fully understood from the following detailed description and the accompanying drawings and Sequence Listing, which form a part of this application.

FIG. 1 depict schematic illustrations of the T-DNA molecules used in the maize SDN3 experiments. FIG. 1A: Donor DNA with homology arms is not flanked with TS sequences with PAM. FIG. 1B: Donor DNA with homology arms flanked with TS sequences with PAM.

FIG. 2 depicts sequence verification methods. FIG. 2A: T0 plants were regenerated using nptII gene as selectable marker and analyzed by junction qPCR for targeted gene insertion. FIG. 2B: 2xHDR positive events were further analyzed by long PCR to evaluate the size and integrity of the insertion.

Figure 5:
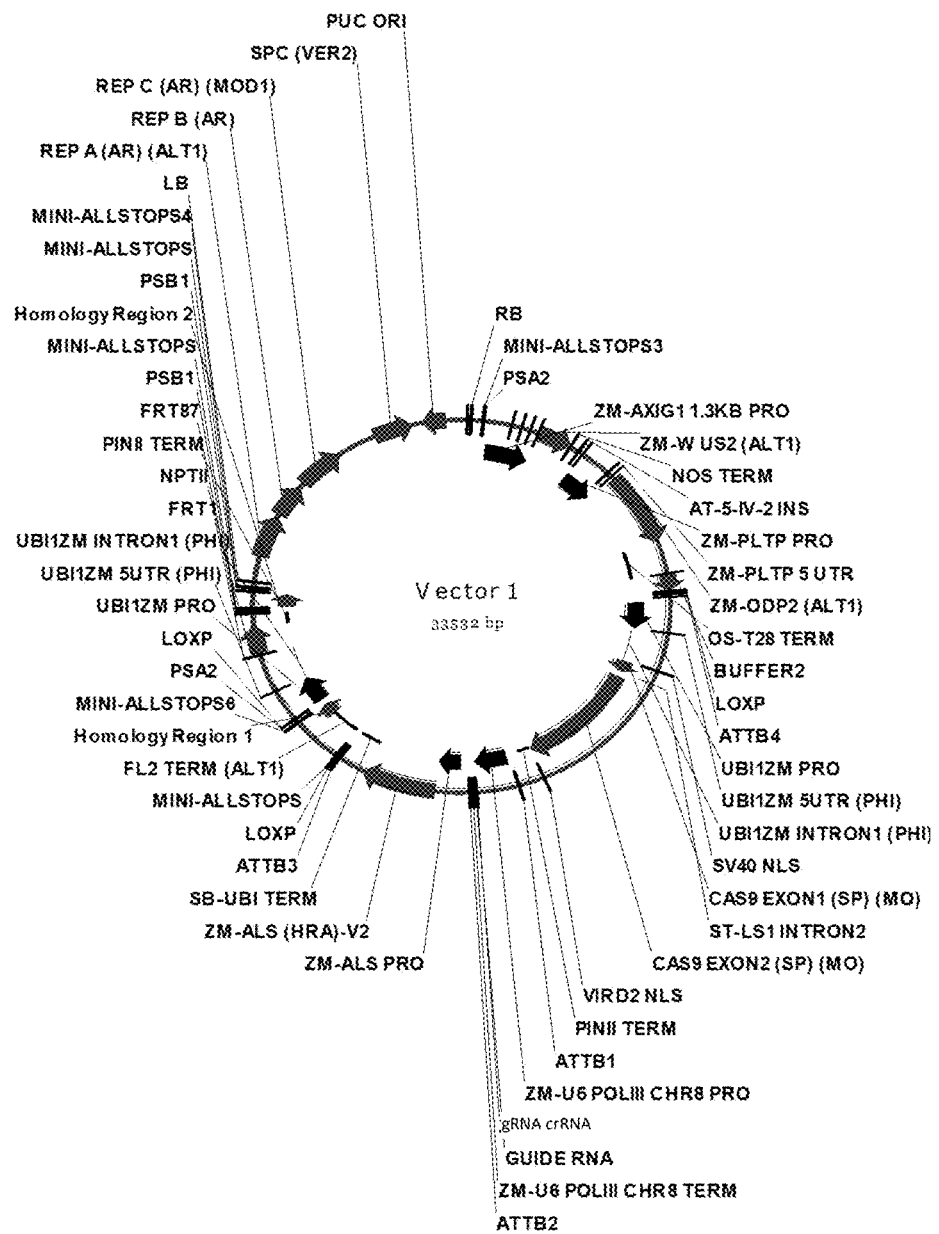

FIG. 5 depicts maize SDN3 transformation Vector 1 (SEQID NO:46), comprising a Dev gene cassette, a CRISPR/Cas cassette, and a Donor DNA cassette that is not flanked by target site sequences further comprising a Cas endonuclease PAM site. The Donor DNA cassette comprises a Donor DNA gene operably linked to a promoter, flanked by two polynucleotide sequences that share homology with the target site in maize germplasm Genotype A.

Figure 6:
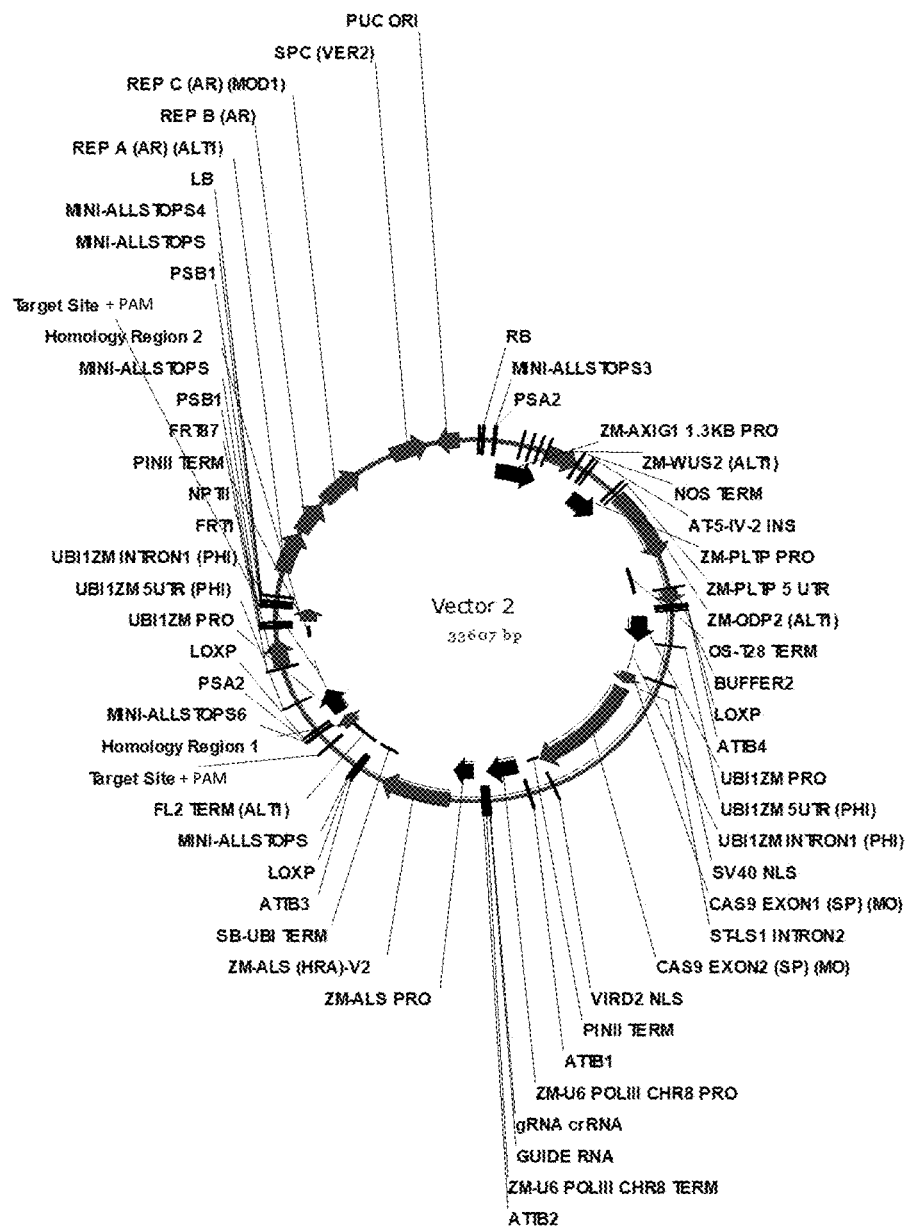

FIG. 6 depicts maize SDN3 transformation Vector 2 (SEQID NO:47), comprising a Dev gene cassette, a CRISPR/Cas cassette, and a Donor DNA cassette that is flanked by target site sequences further comprising a Cas endonuclease PAM site. The Donor DNA cassette comprises a Donor DNA gene operably linked to a promoter, flanked by two polynucleotide sequences that share homology with the target site in maize germplasm Genotype A.

Figure 7:
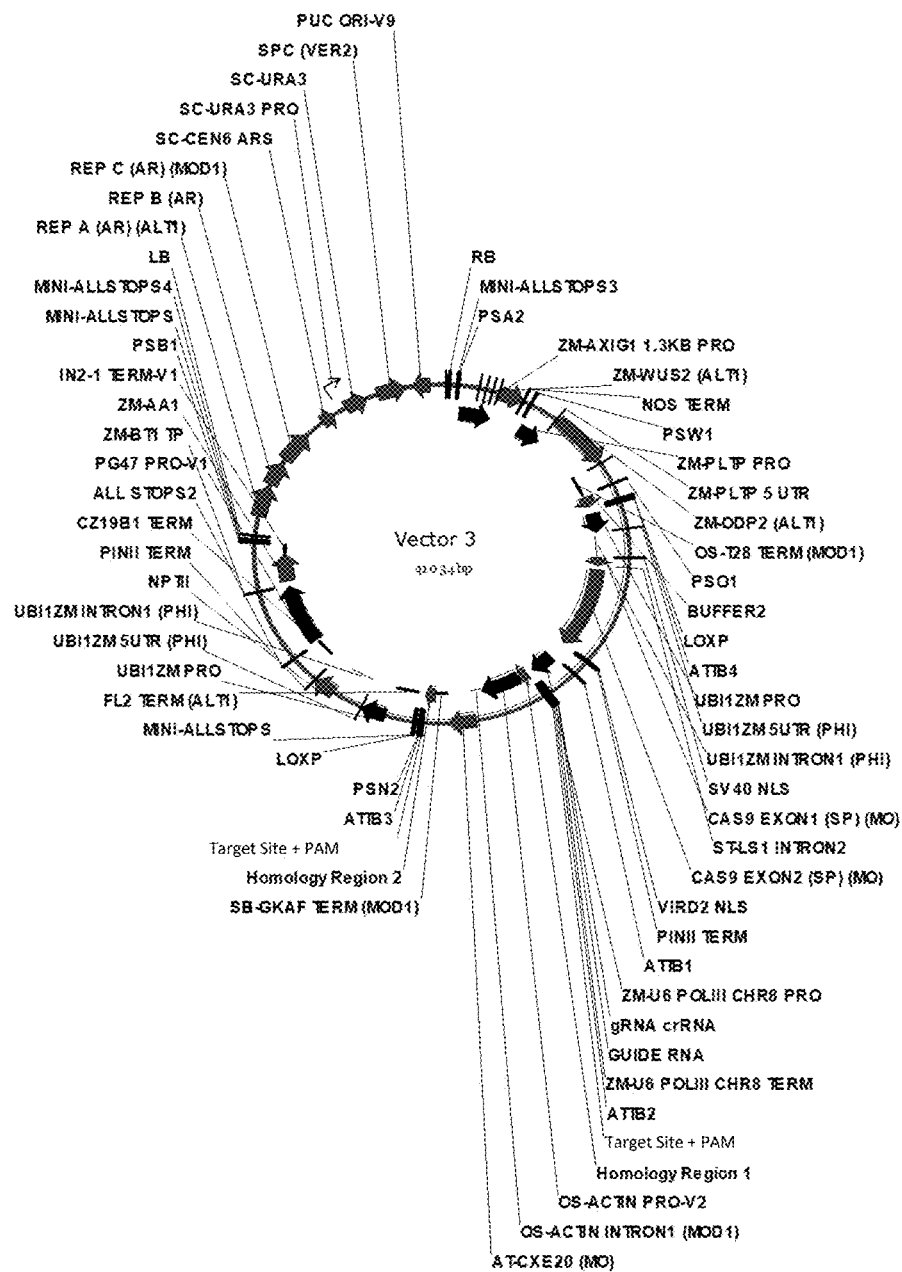

FIG. 7 depicts maize SDN3 transformation Vector 3 (SEQID NO:48), comprising a Dev gene cassette, a CRISPR/Cas cassette, and a Donor DNA cassette that is flanked by target site sequences further comprising a Cas endonuclease PAM site. The Donor DNA cassette comprises a Donor DNA gene operably linked to a promoter, flanked by two polynucleotide sequences that share homology with the target site in maize germplasm Genotype B.

Figure 8:
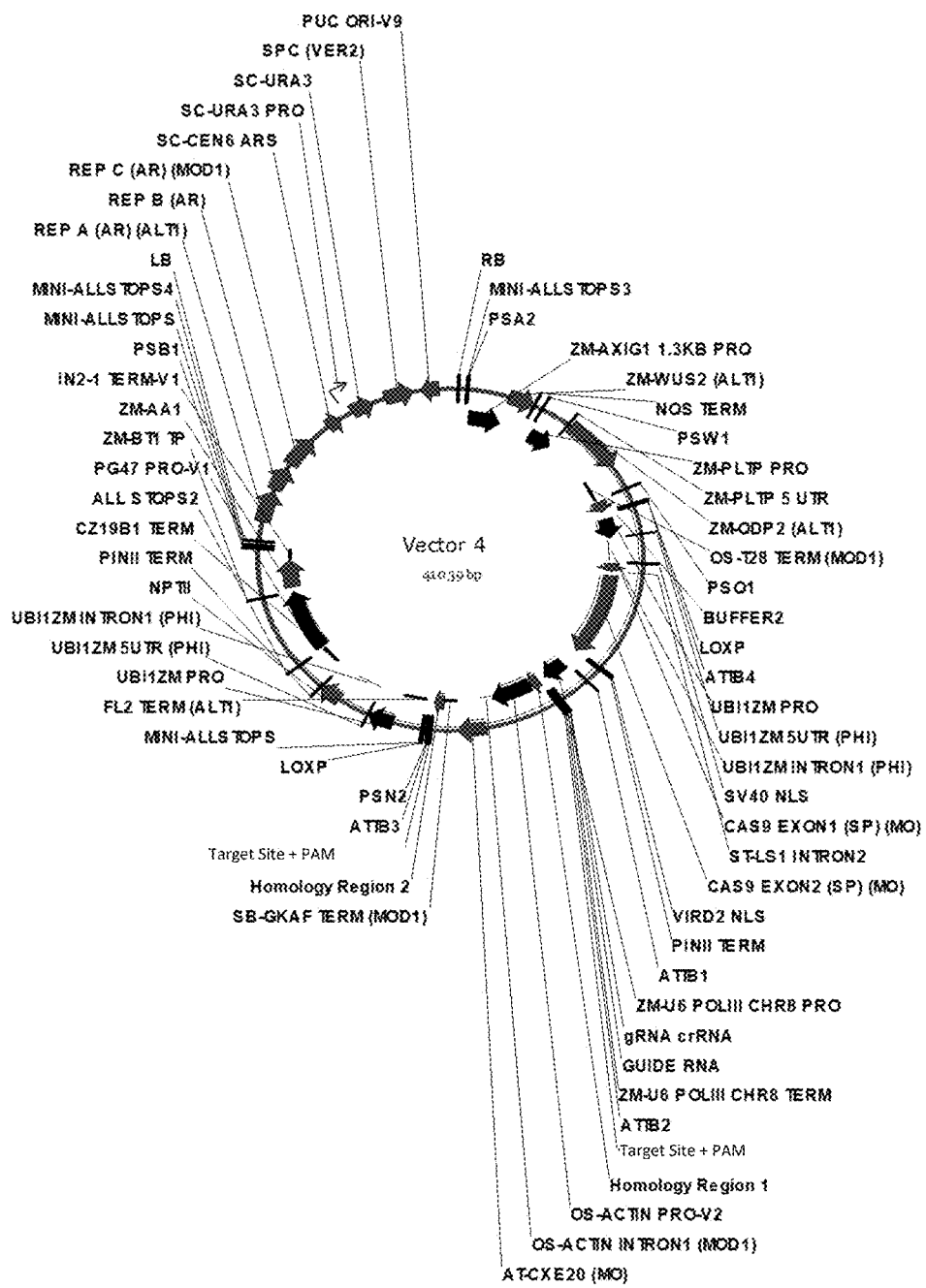

FIG. 8 depicts maize SDN3 transformation Vector 4 (SEQID NO:49), comprising a Dev gene cassette, a CRISPR/Cas cassette, and a Donor DNA cassette that is flanked by target site sequences further comprising a Cas endonuclease PAM site. The Donor DNA cassette comprises a Donor DNA gene operably linked to a promoter, flanked by two polynucleotide sequences that share homology with the target site in maize germplasm Genotype C.

Figure 9:
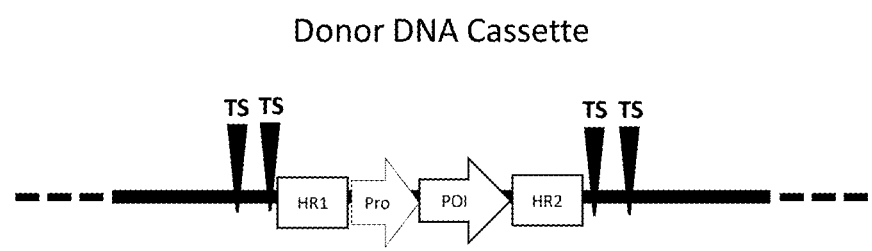

FIG. 9 depicts one example of a plurality of target site (TS) polynucleotide sequences flanking the donor DNA cassette. "POI" stands for "polynucleotide of interest", which in some examples encoded a trait of interest, for example a trait of agronomic importance or interest.

FIG. 10 depicts schematic illustrations of four different vectors for the maize SDN2 experiments, comprising different lengths of template DNA and different orientations of the flanking target sites: the vector of FIG. 10A comprises a 200 nt template flanked by inward-facing target site sequences; the vector of FIG. 10B comprises a 500 nt template flanked by inward-facing target site sequences; the vector of FIG. 10C comprises an 828 nt template flanked by inward-facing target site sequences. FIG. 10D shows part of the template sequence (SEQID NO: 70) comprises 4 SNPs: 3 in the TS sequence and 1 in PAM, denoted by stars.

Figure 11:
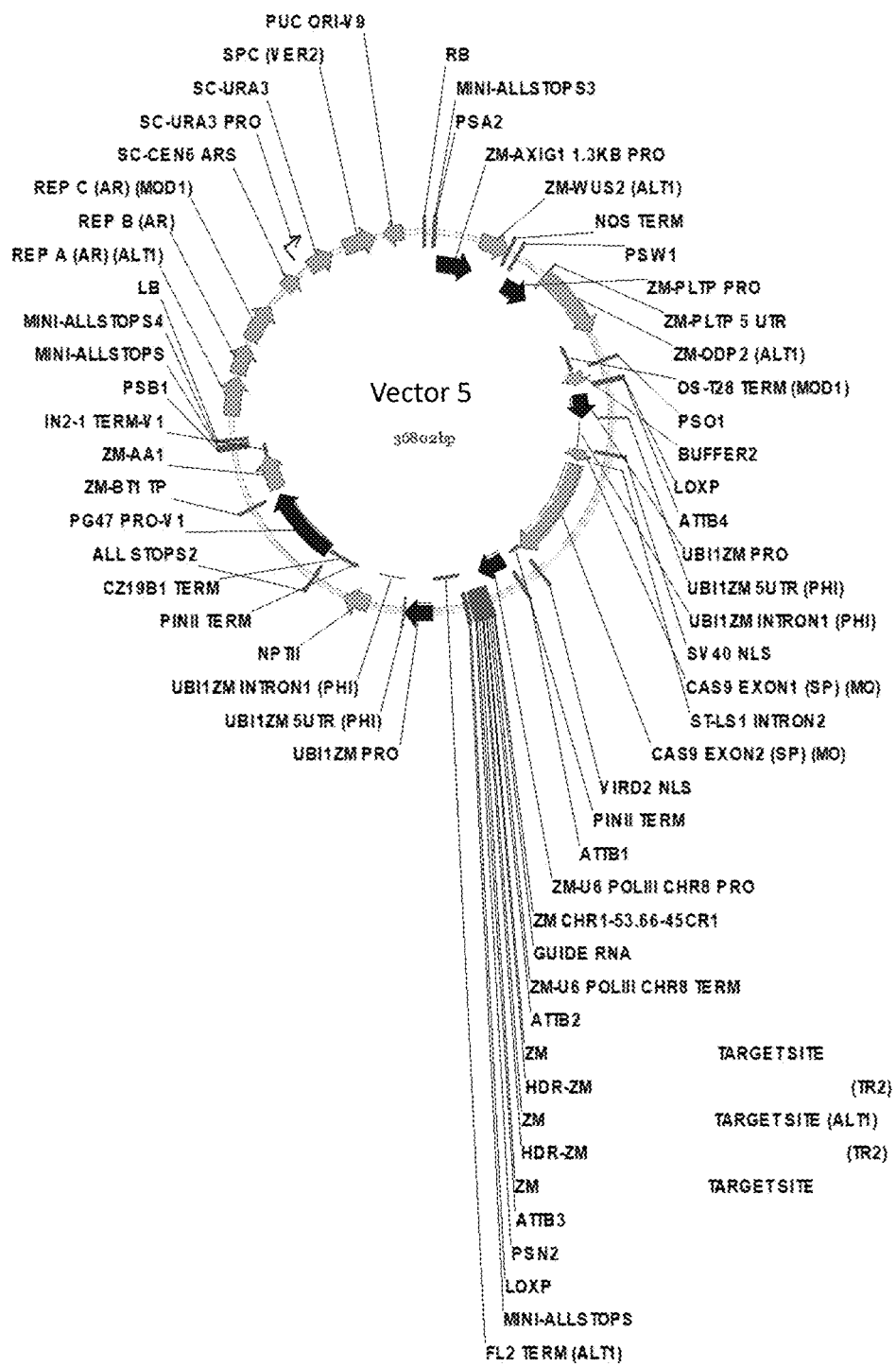

FIG. 11 depicts maize transformation Vector 5 (SEQID NO:50), corresponding to the schematic of FIG. 10A.

Figure 12:
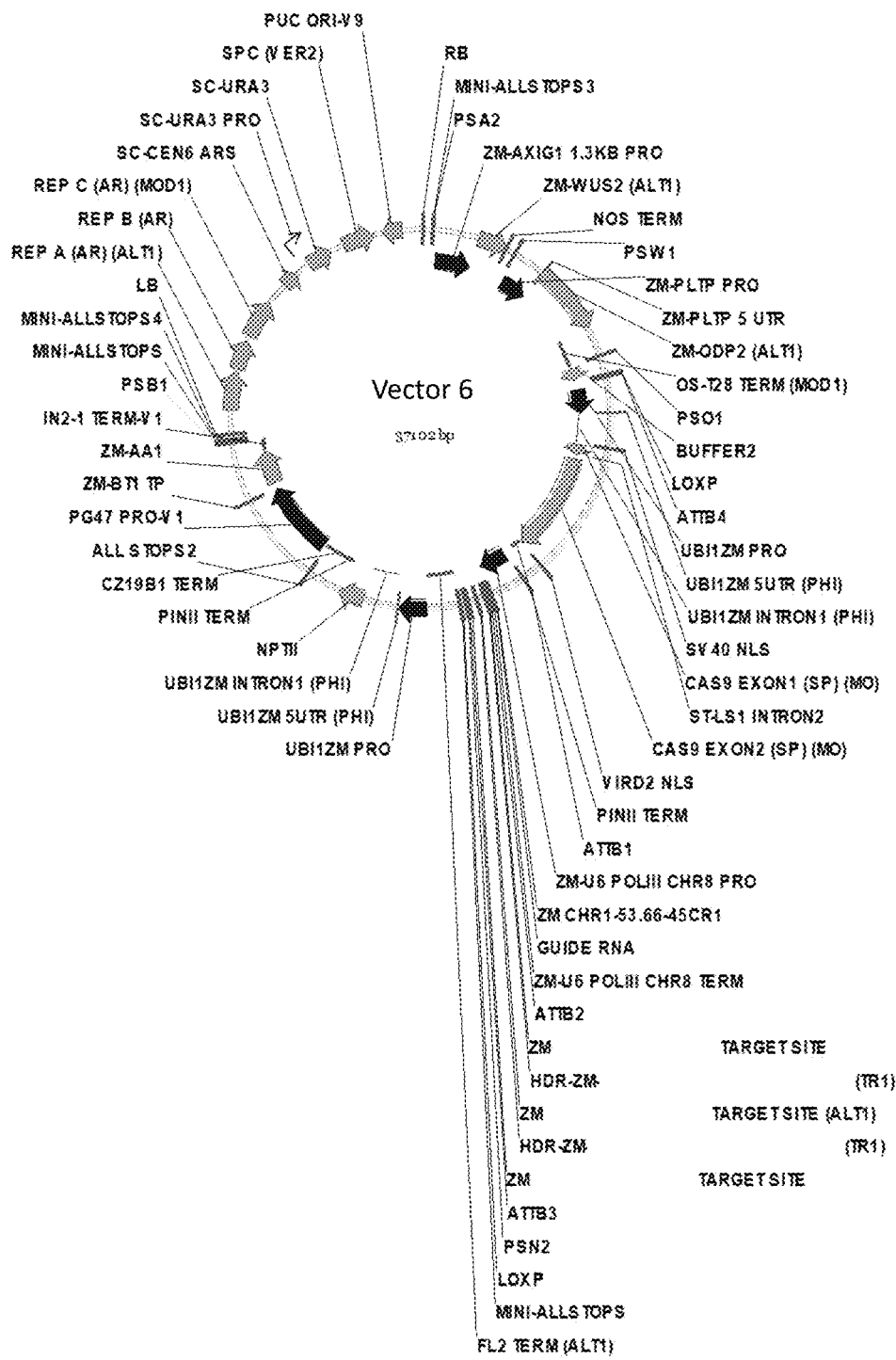

FIG. 12 depicts maize transformation Vector 6 (SEQID NO:51), corresponding to the schematic of FIG. 10B.

Figure 13:
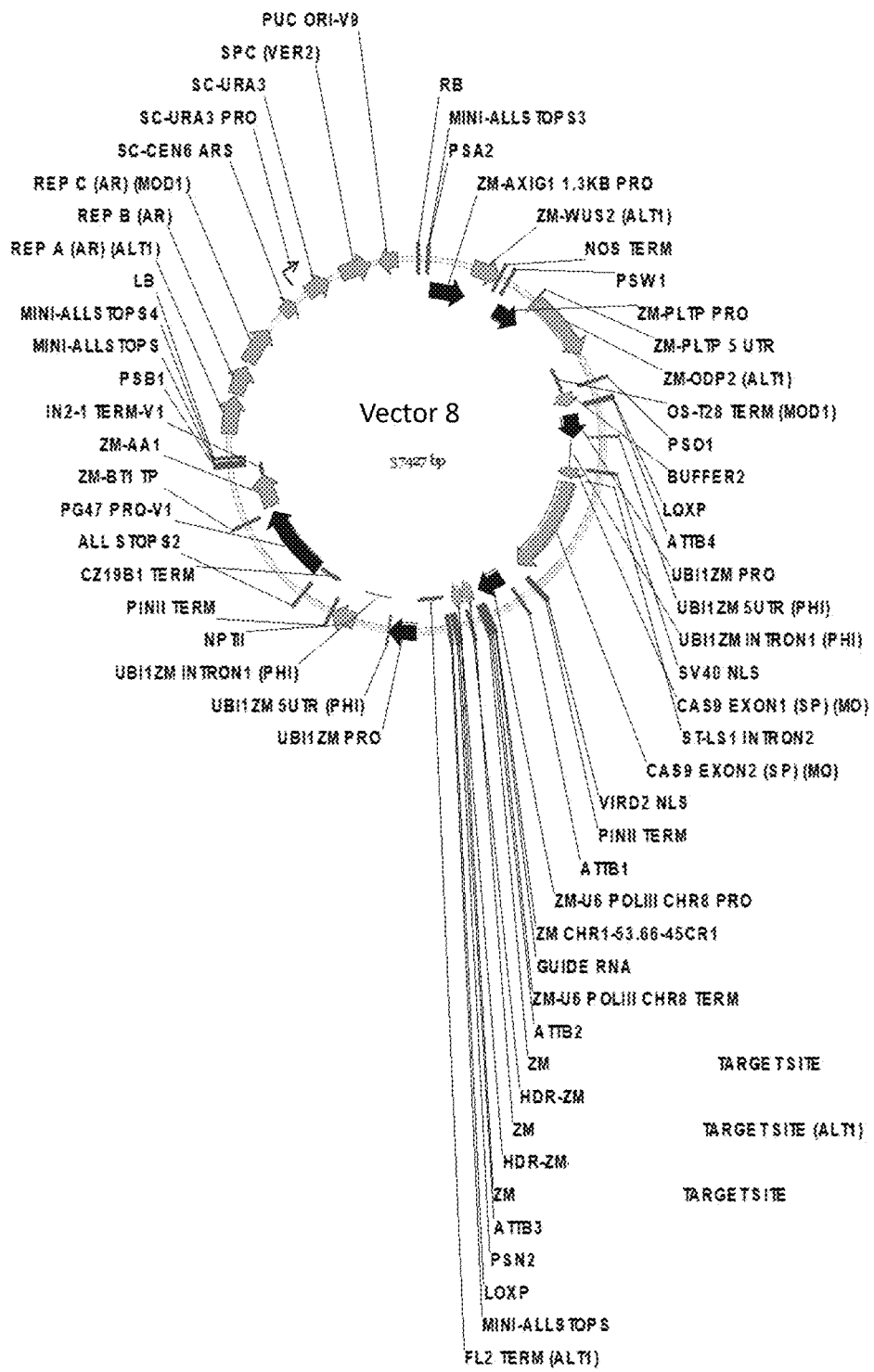

FIG. 13 depicts maize transformation Vector 8 (SEQID NO:53), corresponding to the schematic of FIG. 10C.

Figure 14:
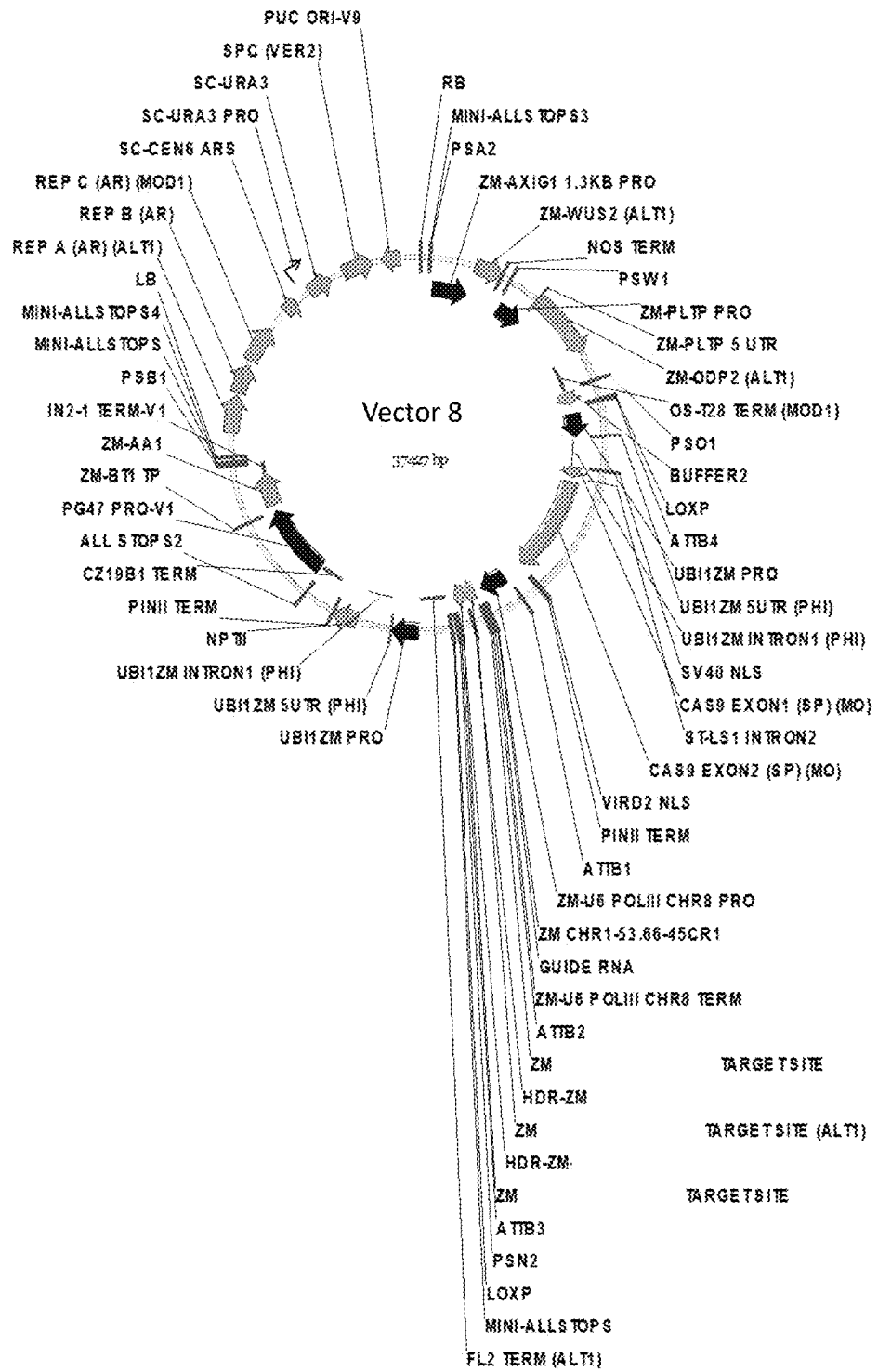

FIG. 14 depicts maize transformation Vector 8 (SEQID NO:53), corresponding to the schematic of FIG. 10C.

Figure 15:
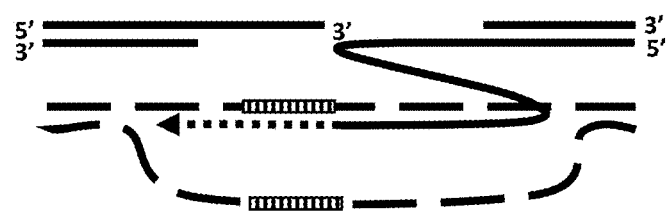

FIG. 15 illustrates a mechanism of action for accomplishing template-directed repair of a double strand break at a target site.

Figure 16:
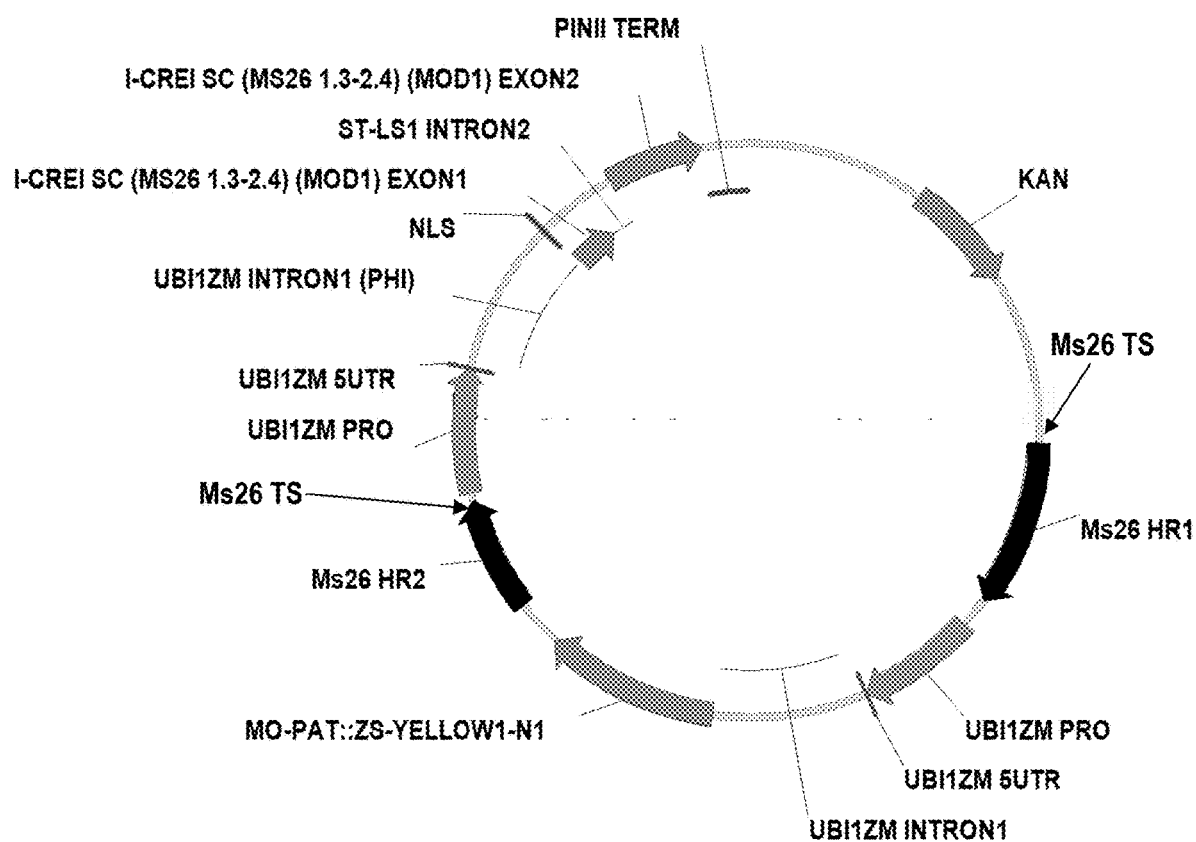

FIG. 16 depicts a maize transformation construct used for Meganuclease-mediated site-specific integration (SDN3) at a target site (MS26) in maize, comprising the MS26 target sites flanking the cassette for integration outside of the MS26 homology regions.

Figure 17A:
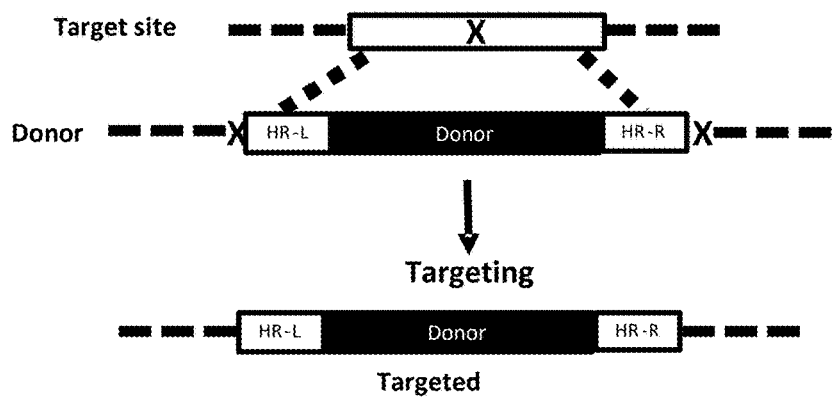
Figure 17B:
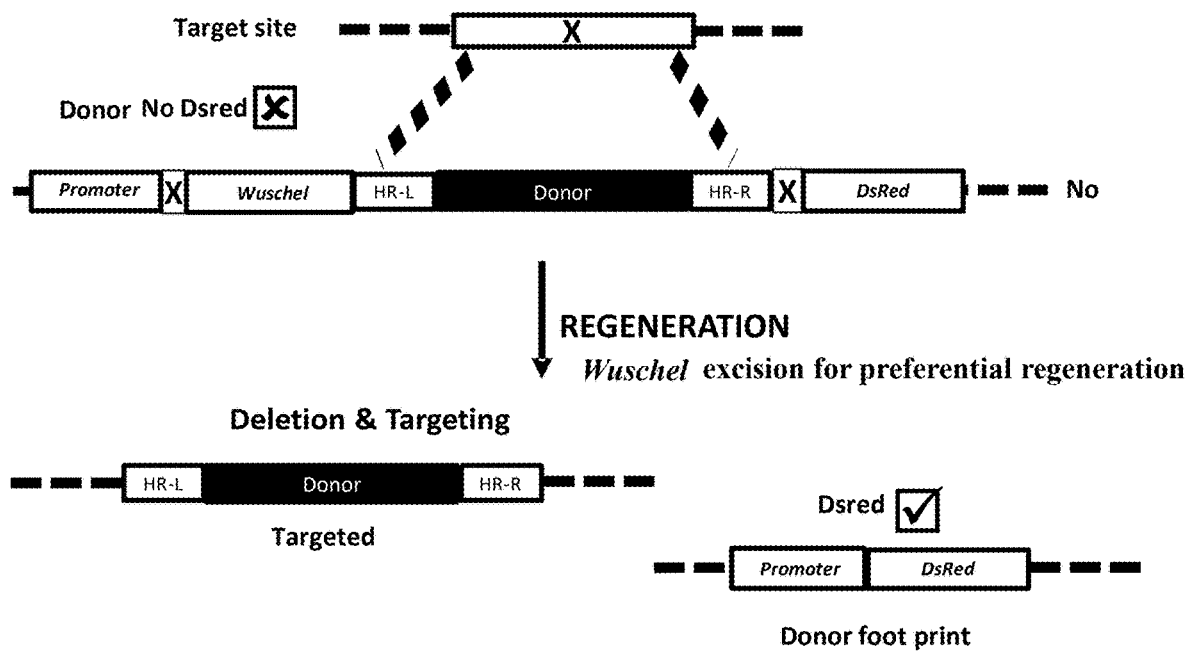

FIG. 17 depicts schematic illustrations for the SDN3 experiments in soybean. FIG. 17A shows target sites flanking the polynucleotide modification template. FIG. 17B shows one embodiment of using a morphogenic factor (Wuschel) for preferential regeneration.

FIG. 18 depicts schematic illustrations of different vectors and experimental strategies for the soybean HDR experiments. FIG. 18A depicts the experimental strategy for Vector 9. FIG. 18B depicts the experimental strategy for Vector 10. FIG. 18C depicts the experimental strategy for Vector 11. FIG. 18D depicts the experimental strategy for Vector 12. FIG. 18E depicts the experimental strategy for Vector 13. FIG. 18F depicts the experimental strategy for Vector 14. FIG. 18G depicts the experimental strategy for Vector 15. FIG. 18H depicts the experimental strategy for Vector 16. FIG. 18I depicts the experimental strategy for Vector 9. FIG. 18A depicts the experimental strategy for Vector 17.

Figure 18D:
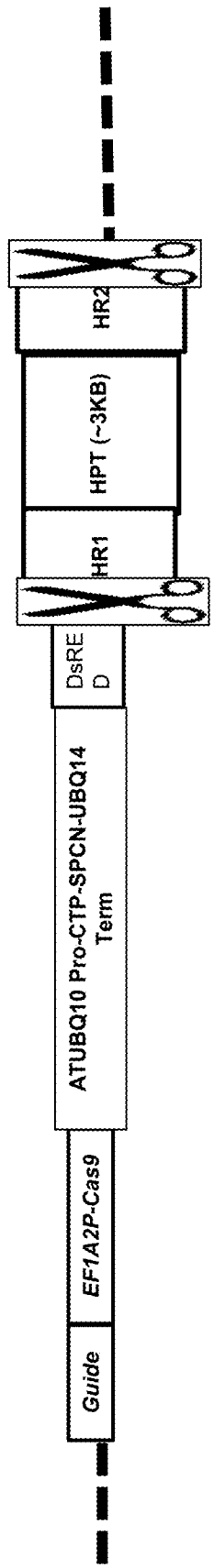
Figure 19:
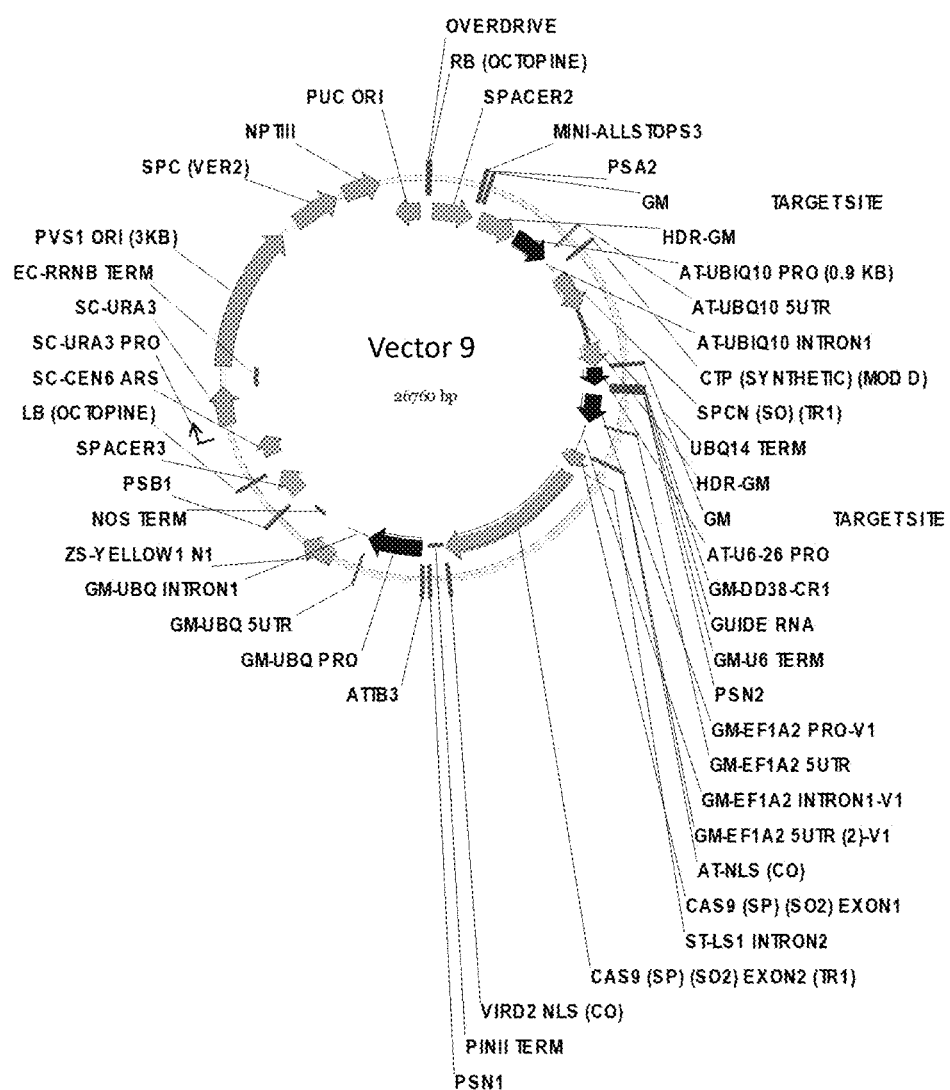

FIG. 19 depicts soy transformation Vector 9 (SEQID NO:54), corresponding to the schematic of FIG. 18A.

Figure 20:
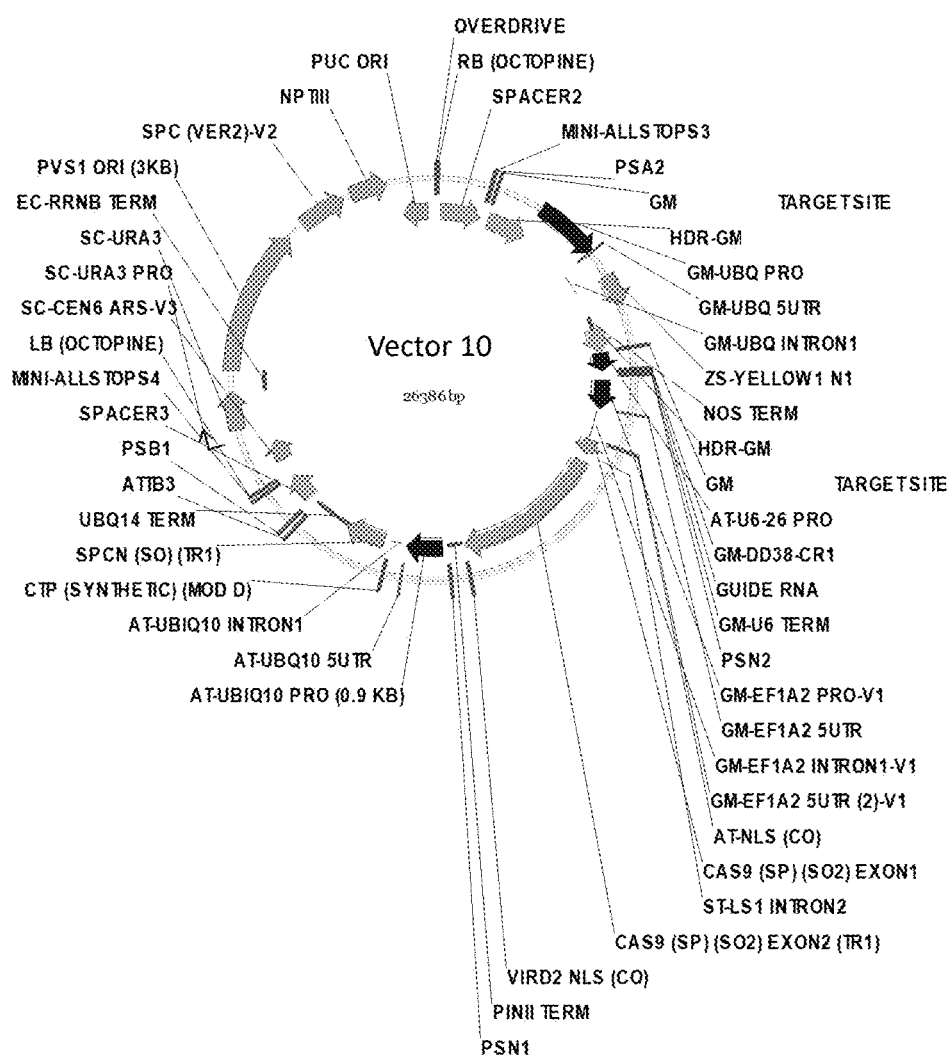

FIG. 20 depicts soy transformation Vector 10 (SEQID NO:55), corresponding to the schematic of FIG. 18B.

Figure 21:
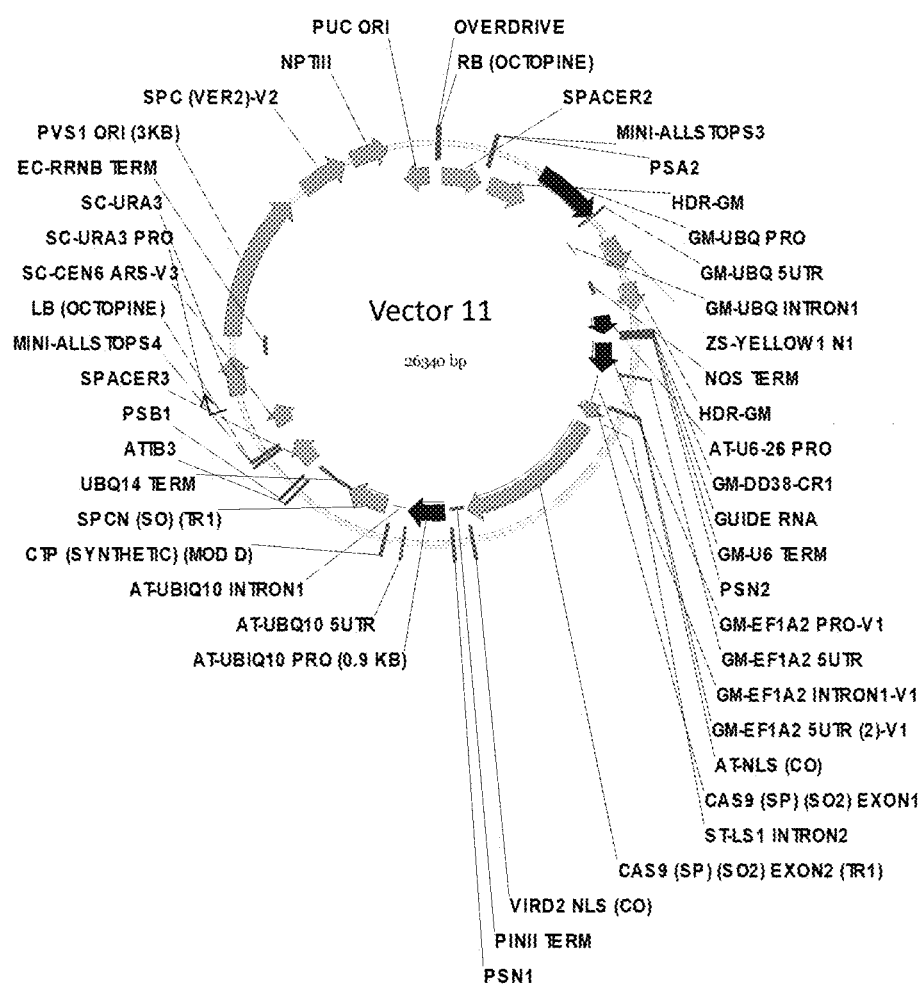

FIG. 21 depicts soy transformation Vector 11 (SEQID NO:56), corresponding to the schematic of FIG. 18C.

Figure 22:
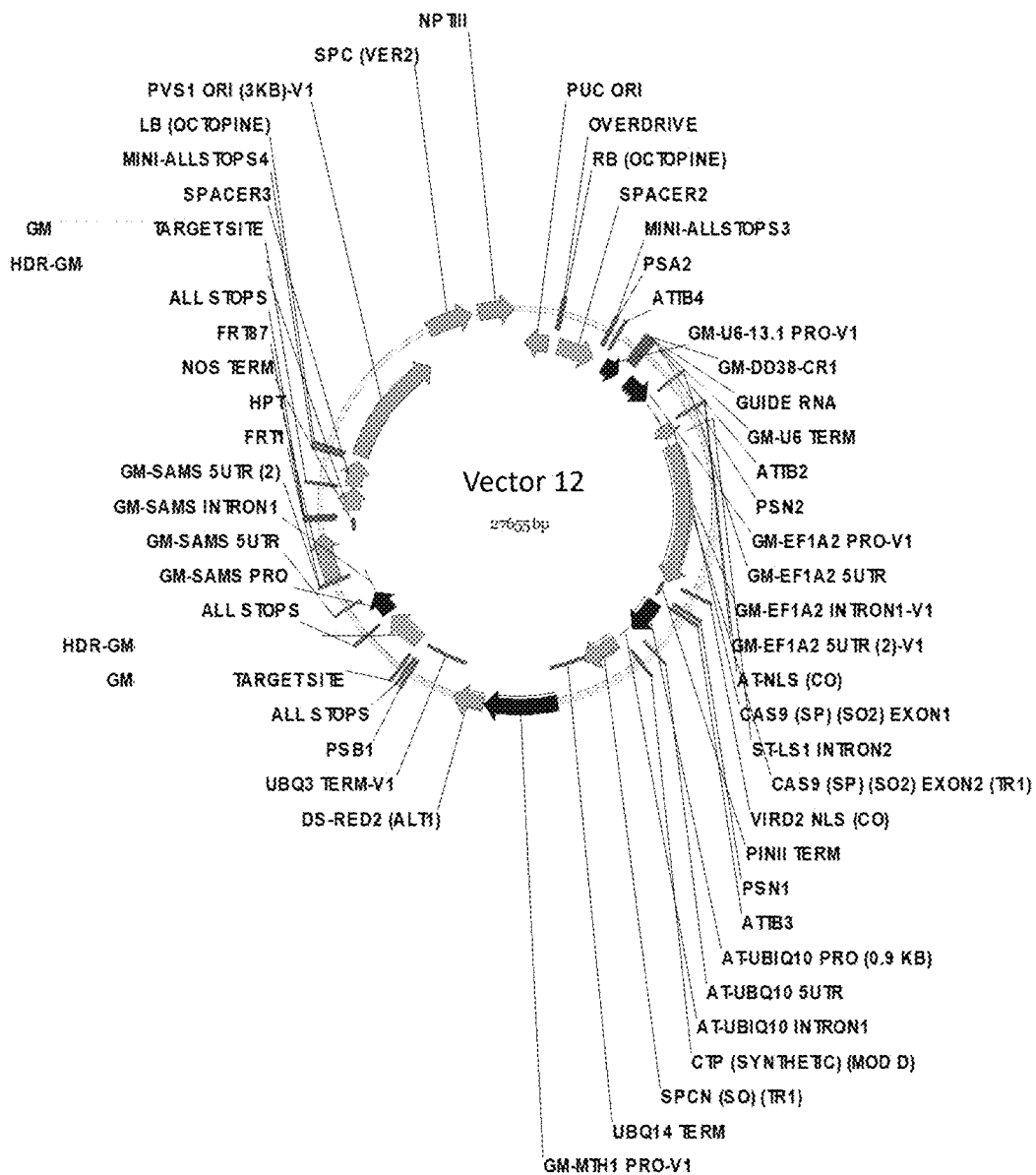

FIG. 22 depicts soy transformation Vector 12 (SEQID NO:57), corresponding to the schematic of FIG. 18D.

Figure 18E:
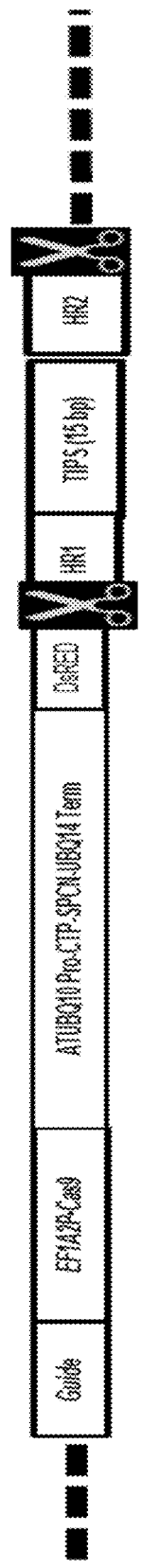
Figure 23:
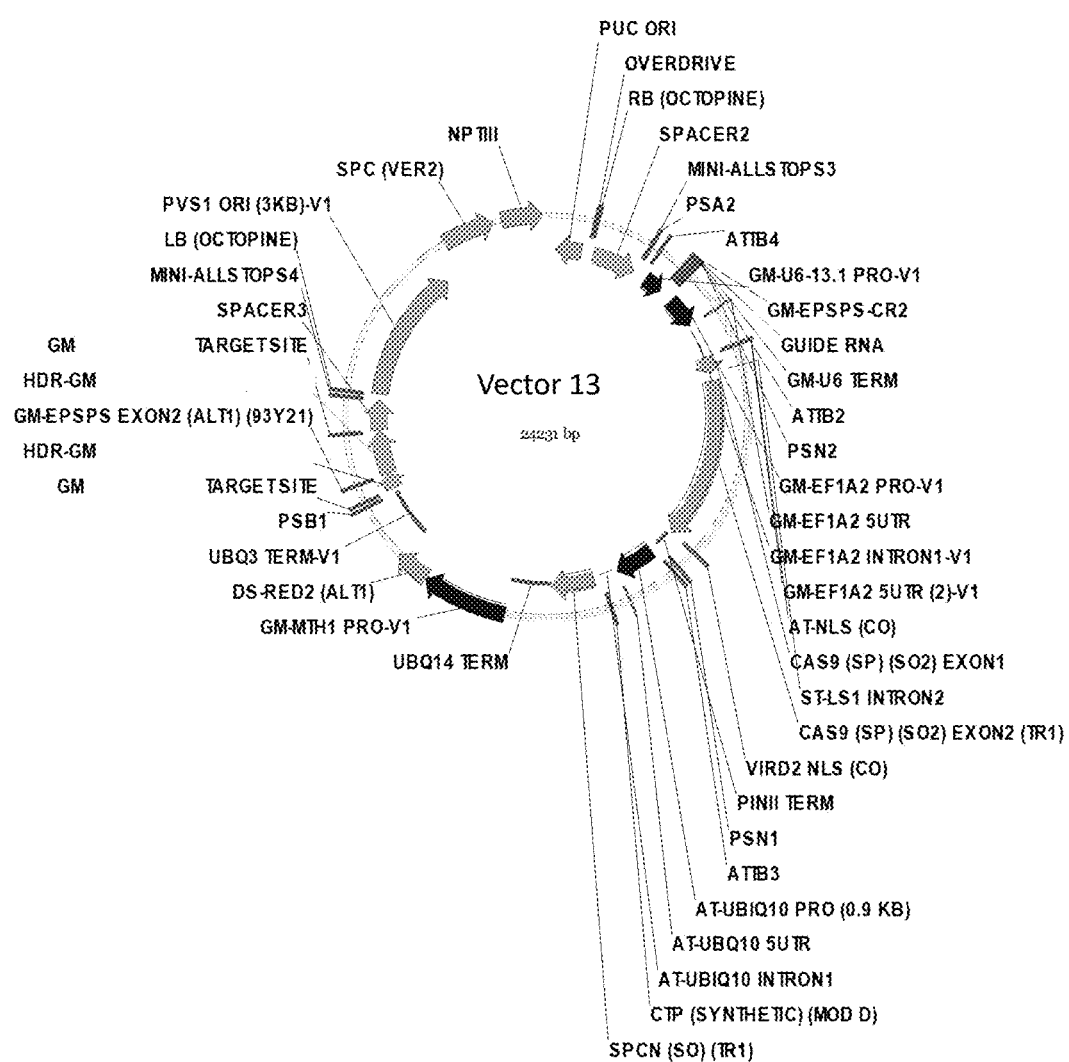

FIG. 23 depicts soy transformation Vector 13 (SEQID NO:58), corresponding to the schematic of FIG. 18E.

Figure 18F:
Figure 24:
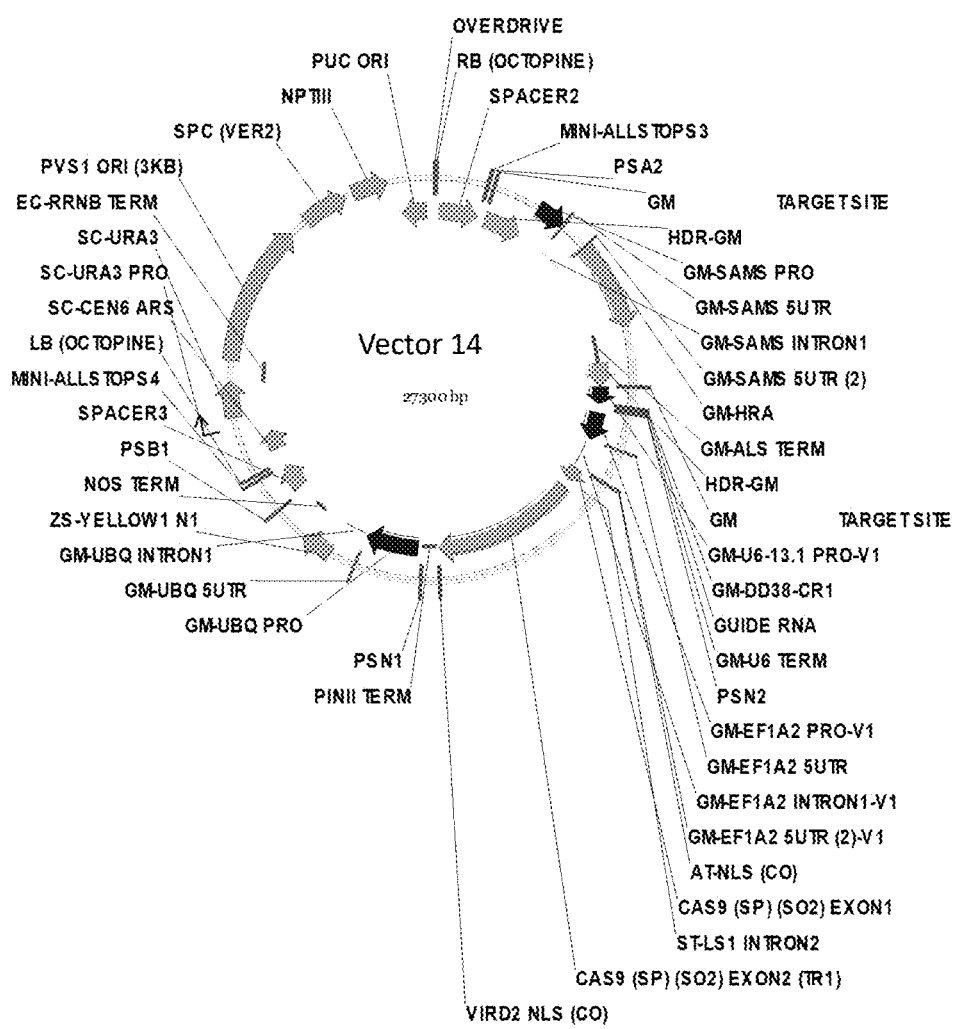

FIG. 24 depicts soy transformation Vector 14 (SEQID NO:59), corresponding to the schematic of FIG. 18F.

Figure 18G:
Figure 25:
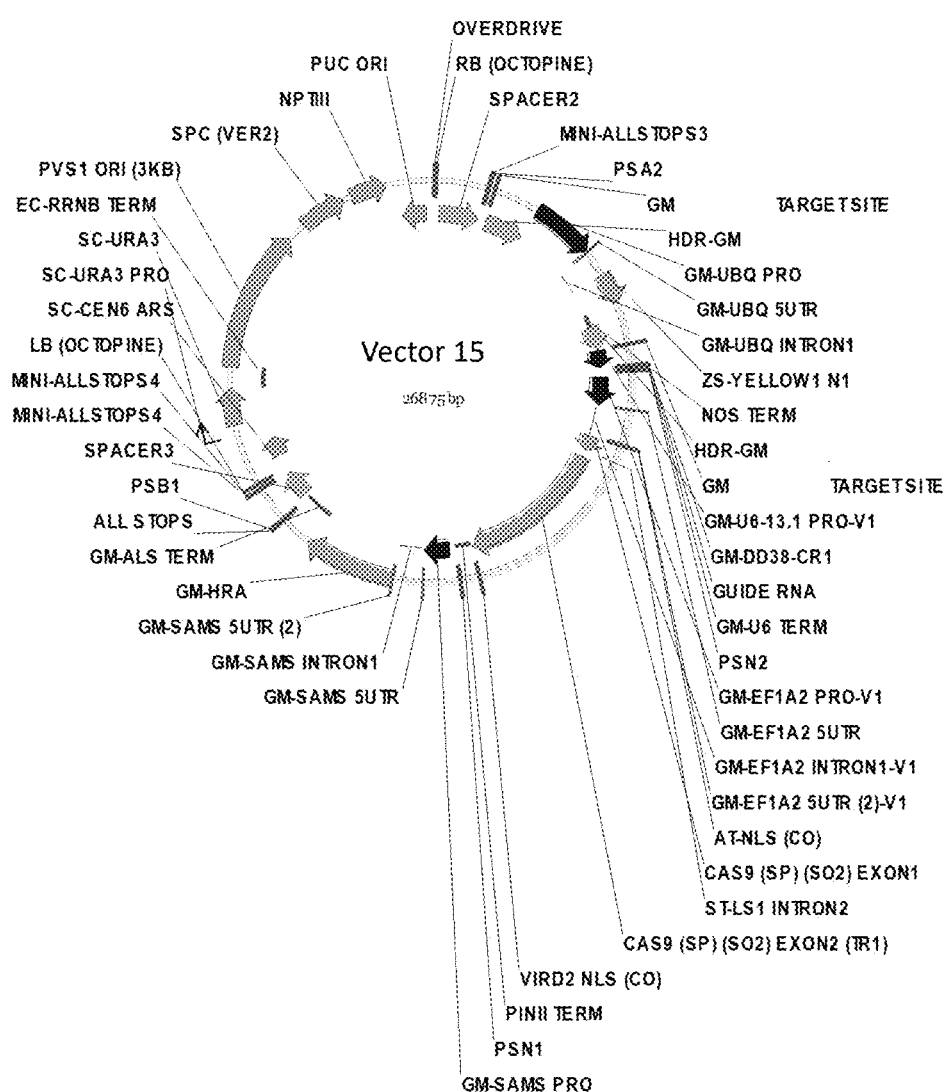

FIG. 25 depicts soy transformation Vector 15 (SEQID NO:60), corresponding to the schematic of FIG. 18G.

Figure 18H:
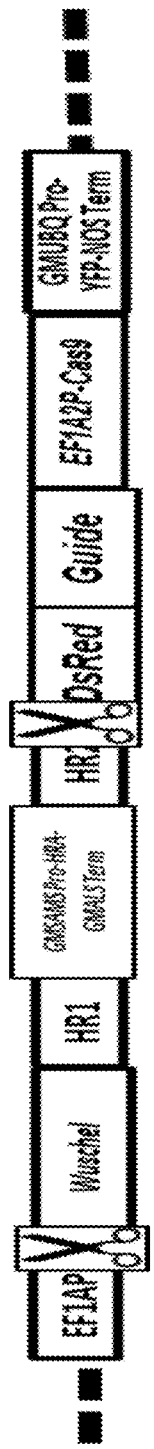
Figure 26:
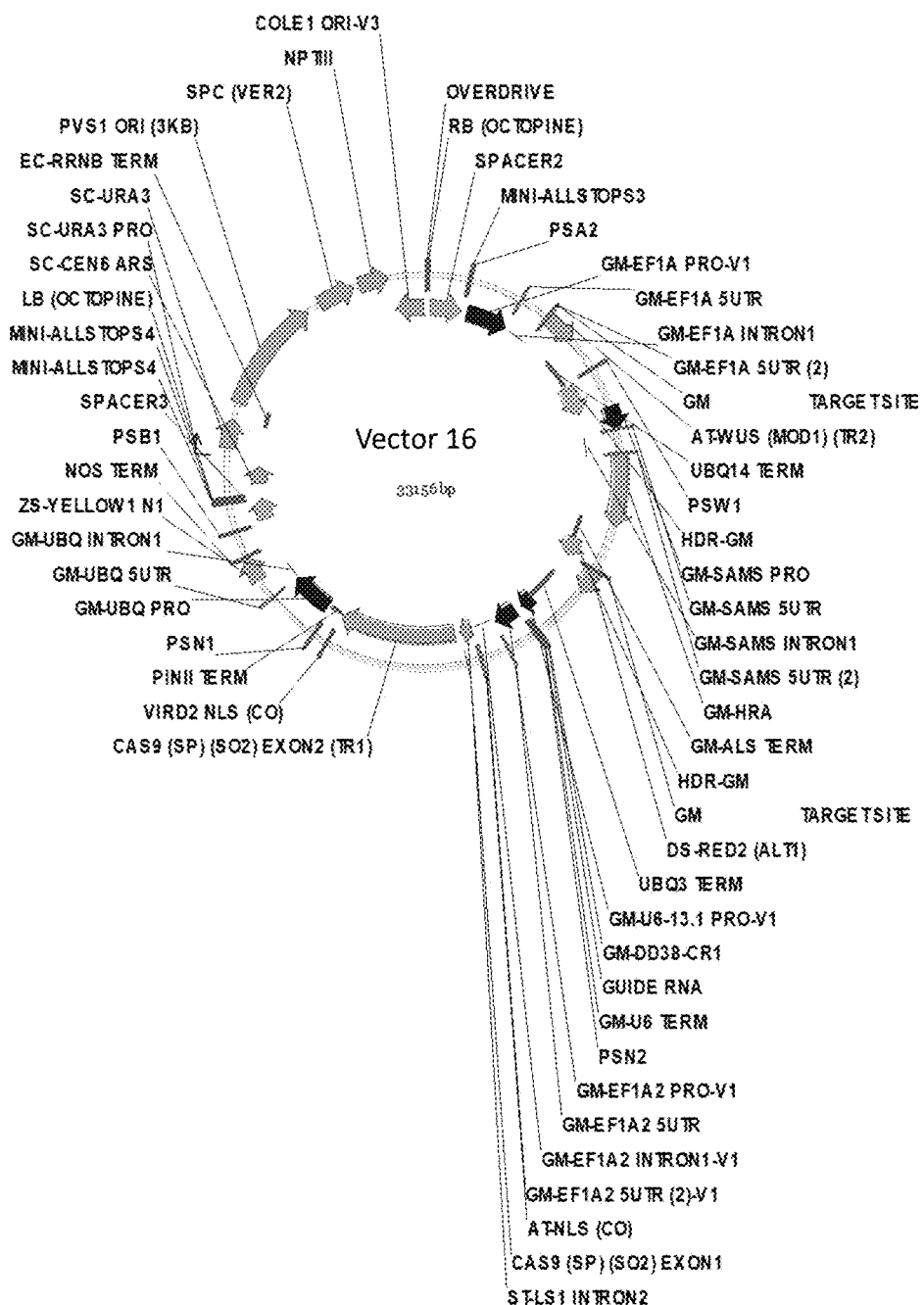

FIG. 26 depicts soy transformation Vector 16 (SEQID NO:61), corresponding to the schematic of FIG. 18H.

Figure 18I:
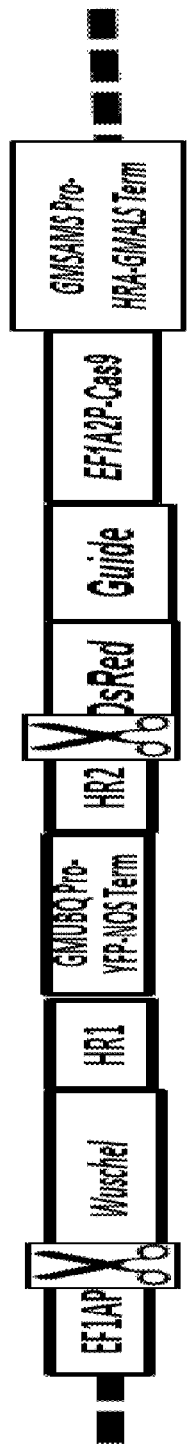
Figure 27:
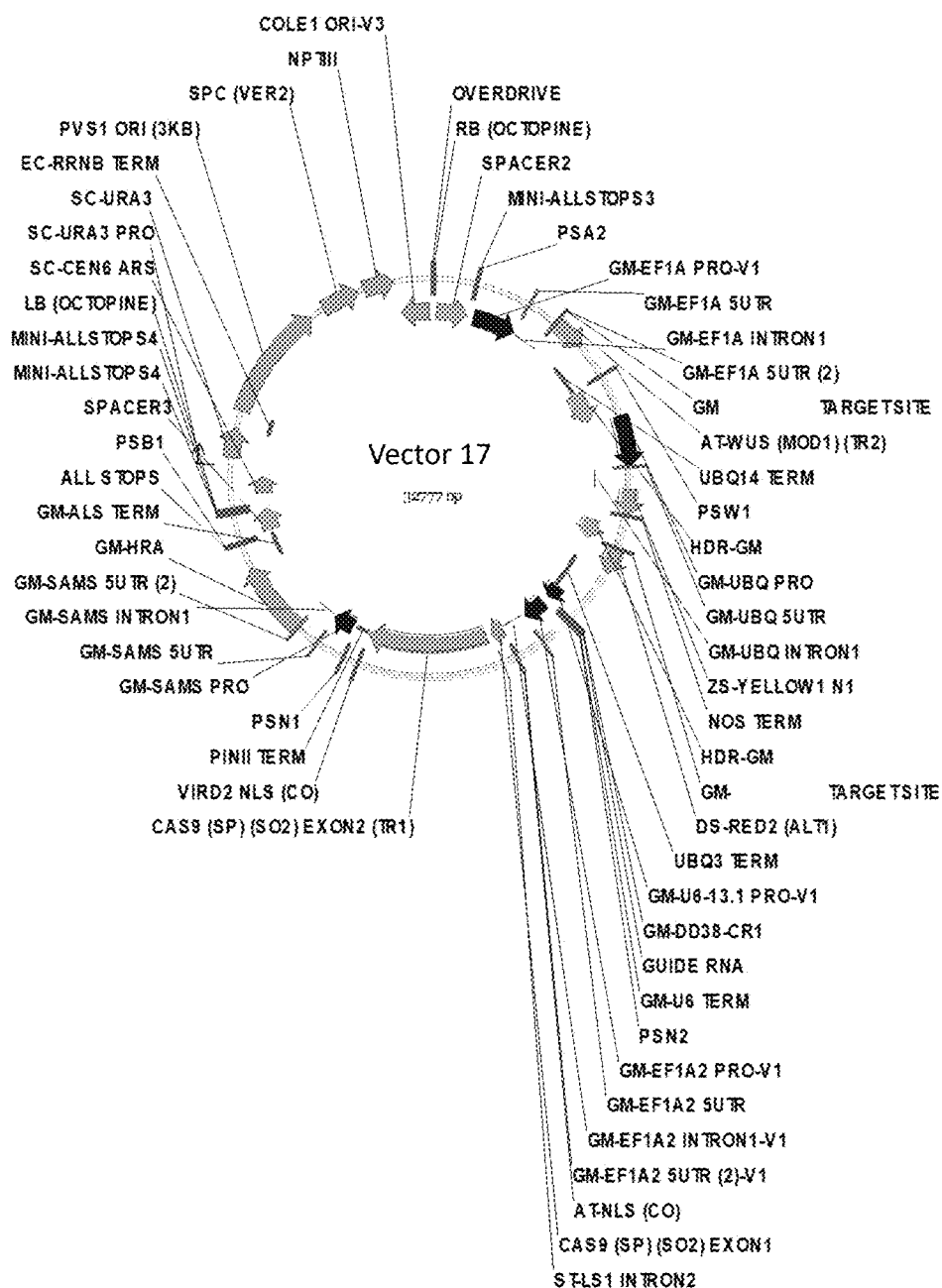

FIG. 27 depicts soy transformation Vector 17 (SEQID NO:62), corresponding to the schematic of FIG. 18I.

Figure 28A:
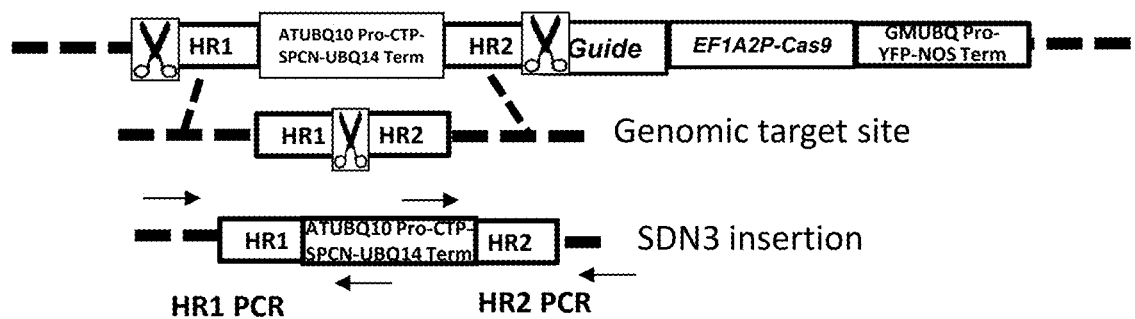
Figure 28B:
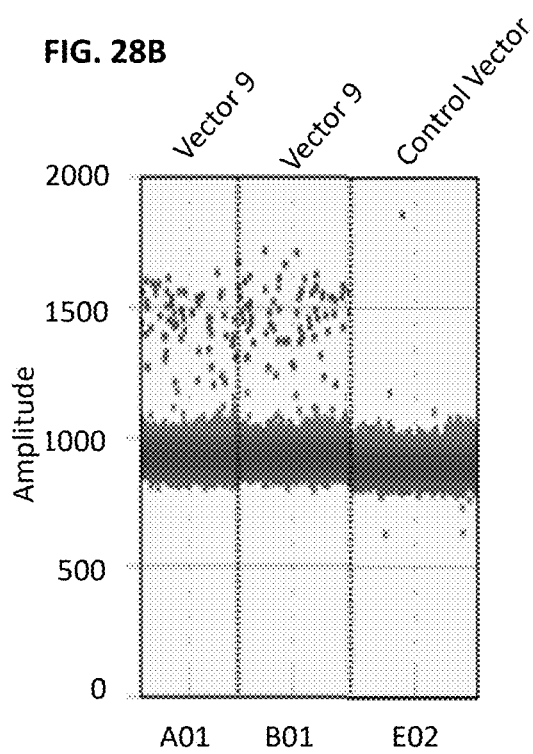
Figure 28C:
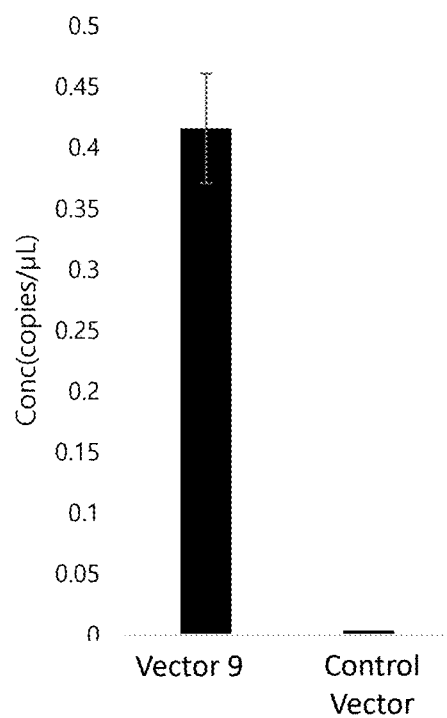

FIG. 28 shows the vector design and experimental strategy (FIG. 28A) and results (FIG. 28B are the individual read results for the samples, and FIG. 28C is the normalized concentration of HDR copy reads) for the soy HDR experiments for Vector 9.

Figure 29A:
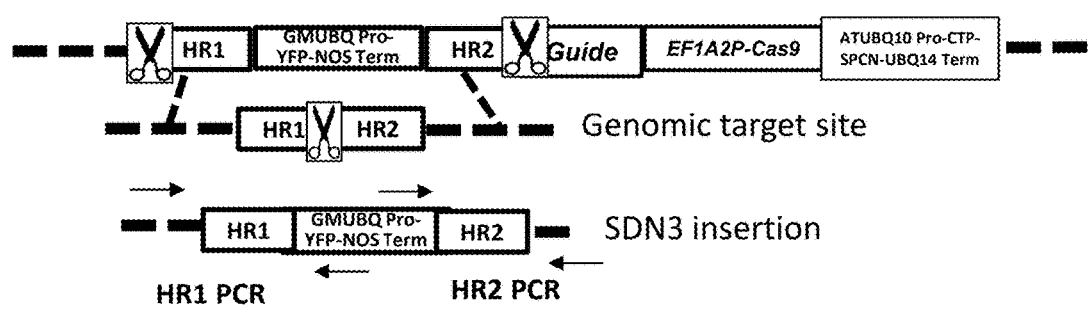
Figure 29B:
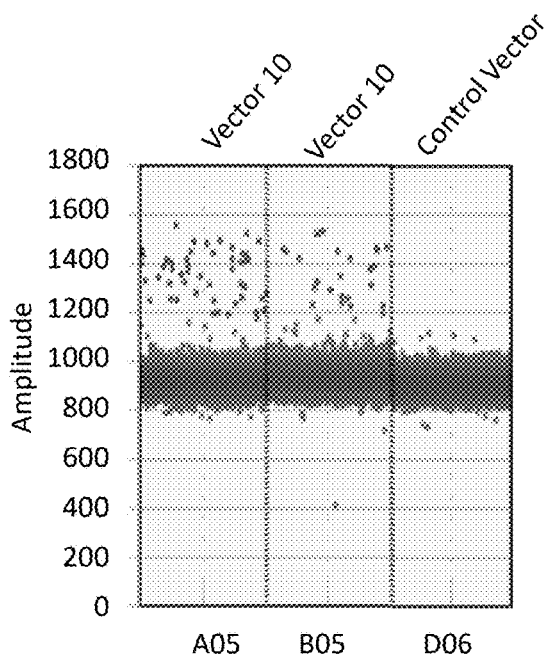
Figure 29C:
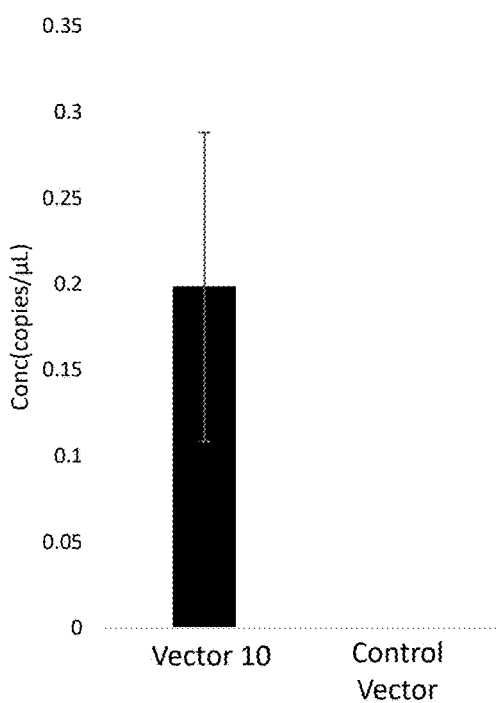

FIG. 29 shows the vector design and experimental strategy (FIG. 29A) and results (FIG. 29B are the individual read results for the samples, and FIG. 29C is the normalized concentration of HDR copy reads) for the soy HDR experiments for Vector 10.

FIG. 30 shows the vector design and experimental strategy and results for the soy SDN2 experiments for Vector 13. FIG. 30A depicts the vector design and experimental strategy. FIG. 30B shows the wild type soy target sequence (SEQID NO:73) and the donor DNA for the gRNA2 (SEQID NO:74). FIGS. 30C and 30D show sequencing verification of edits.

Figure 31:
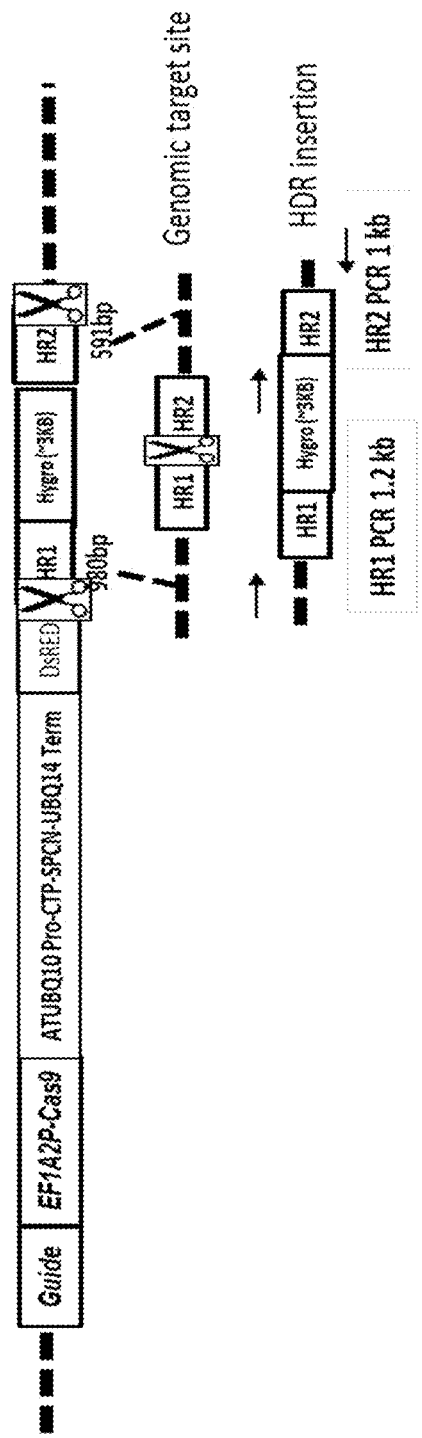

FIG. 31 shows the vector schematic and experimental strategy for the soy HDR experiments for Vector 12.

Figure 32:
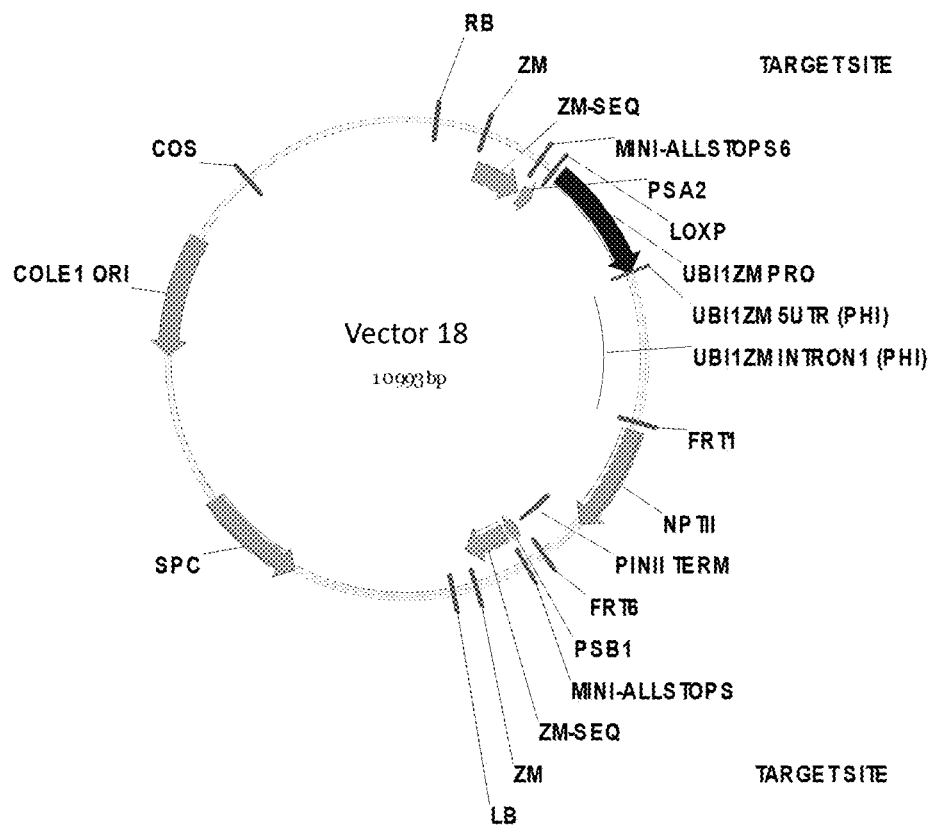

FIG. 32 depicts maize transformation Vector 18 (with flanking target sites) for particle bombardment.

Figure 33:
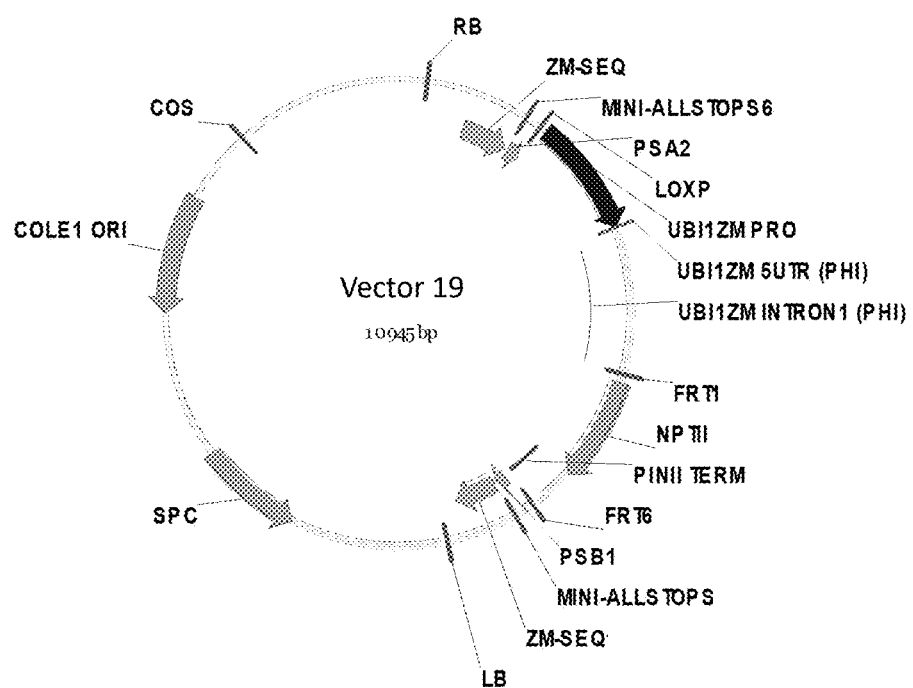

FIG. 33 depicts maize transformation Vector 19 (control, no flanking target sites) for particle bombardment.

Figure 34:
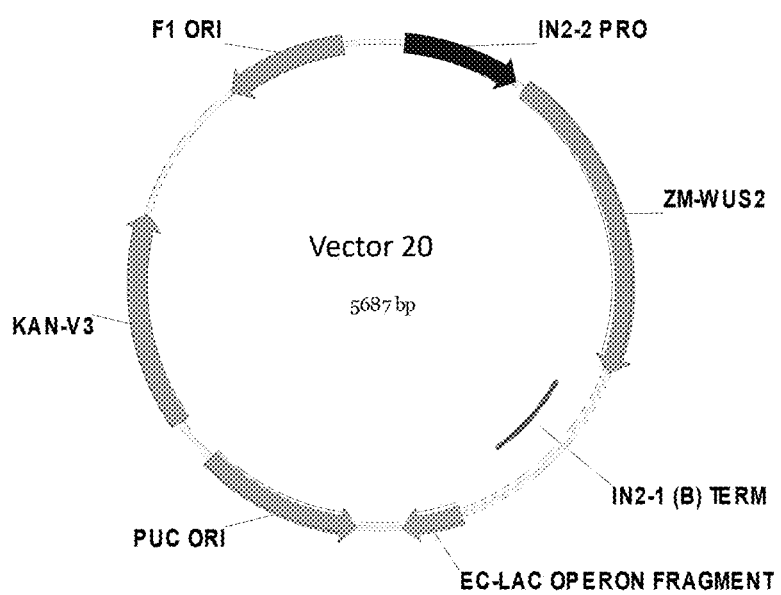

FIG. 34 depicts the WUS morphogenic factor (developmental gene) plasmid Vector 20 used in the meganuclease transformation experiments.

Figure 35:
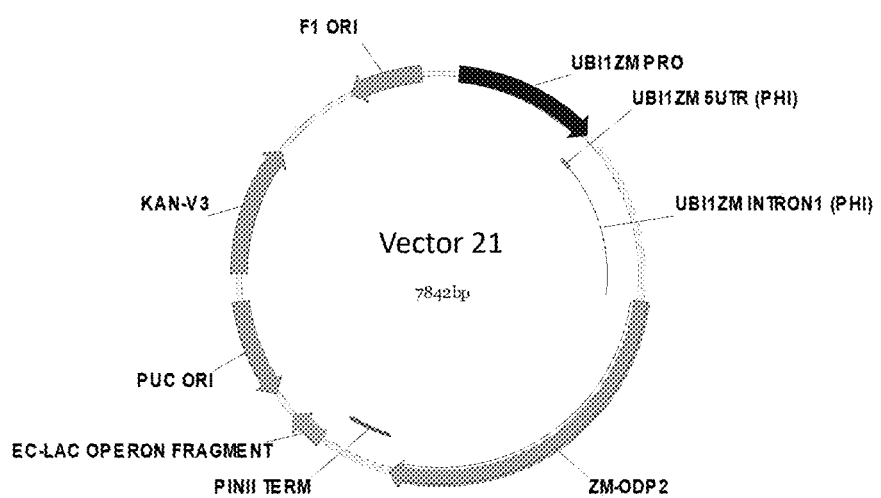

FIG. 35 depicts the ODP morphogenic factor (developmental gene) plasmid Vector 21 used in the meganuclease transformation experiments.

Figure 36:
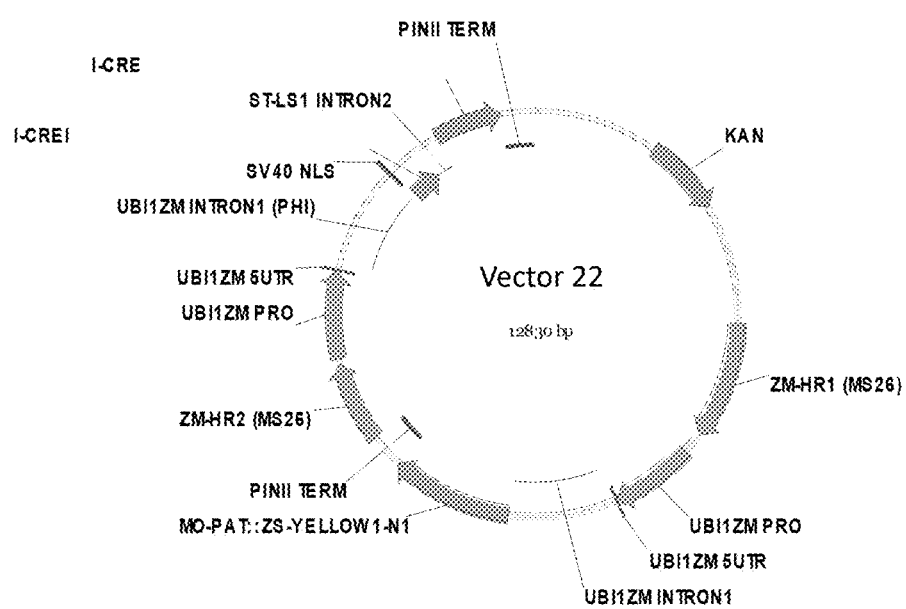

FIG. 36 depicts the transformation Vector 22 used in the meganuclease transformation experiments.

Figure 37:
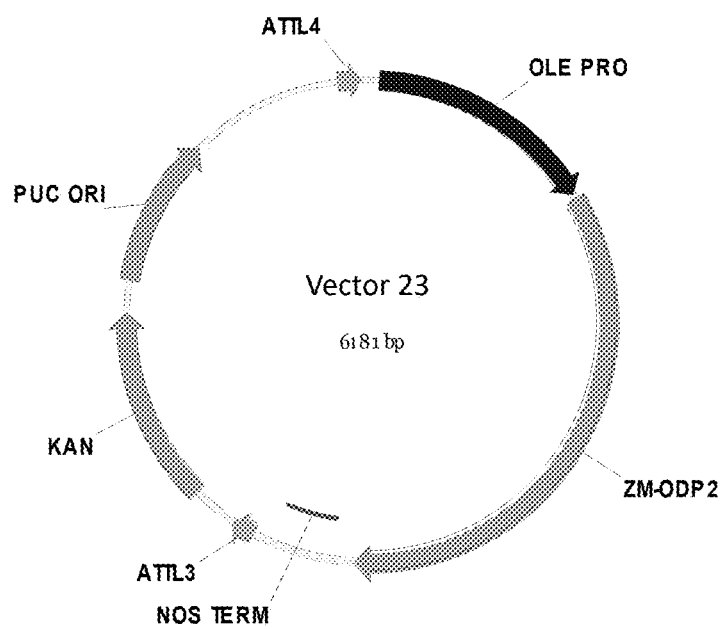

FIG. 37 depicts the transformation Vector 23 used in the meganuclease transformation experiments.

Figure 38:
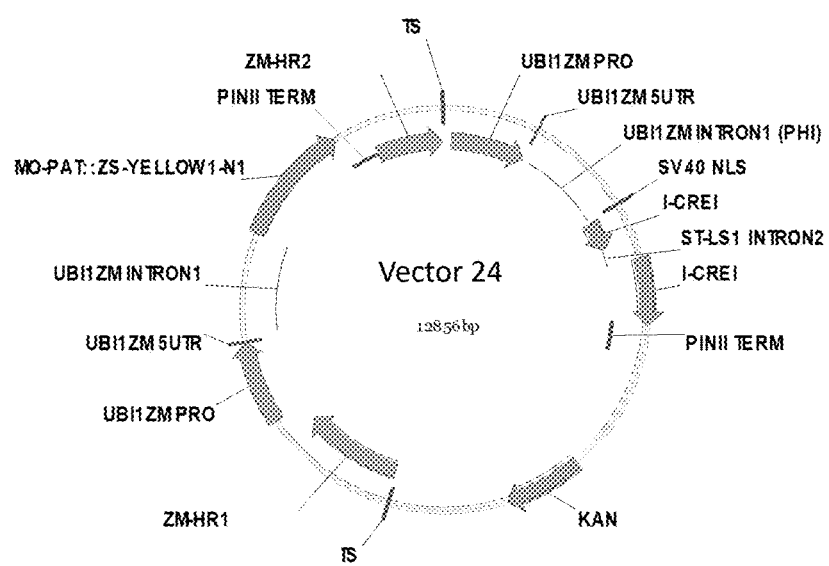

FIG. 38 depicts the transformation Vector 24 used in the meganuclease transformation experiments.

Figure 39A:
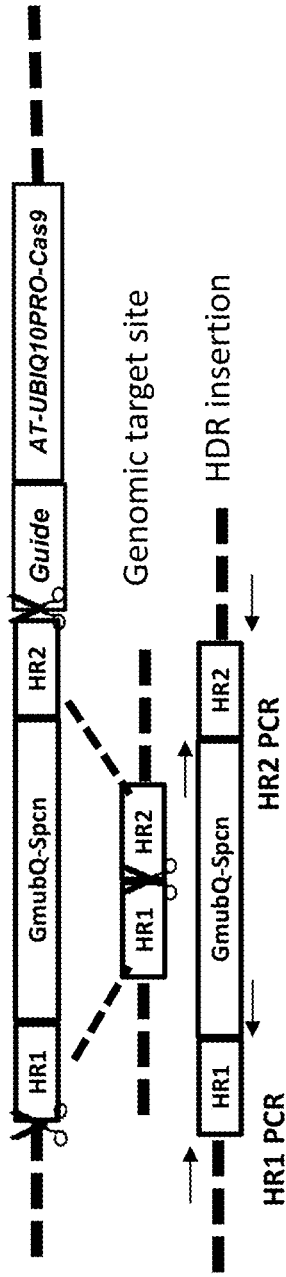
Figure 39B:
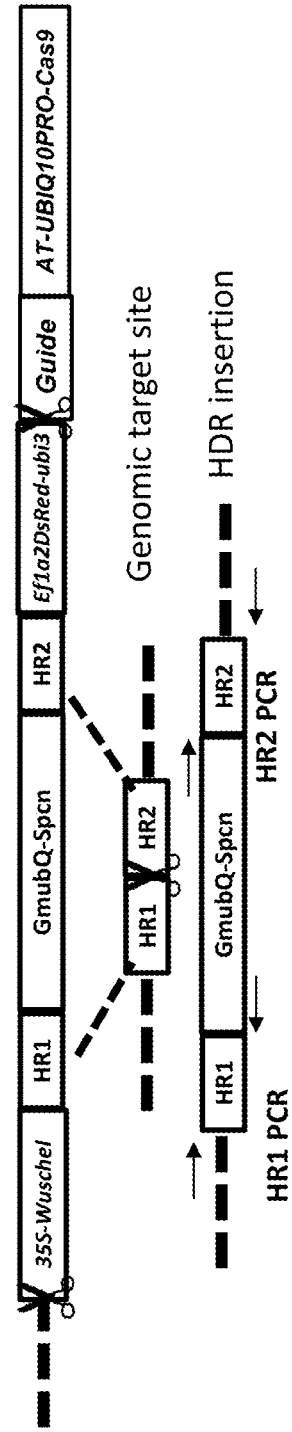

FIG. 39 depicts Canola SDN3 transformation vectors. FIG. 39A depicts the vector schematic and experimental strategy for Vector 25. FIG. 39B depicts the vector schematic and experimental design for Vector 26.

Figure 40:
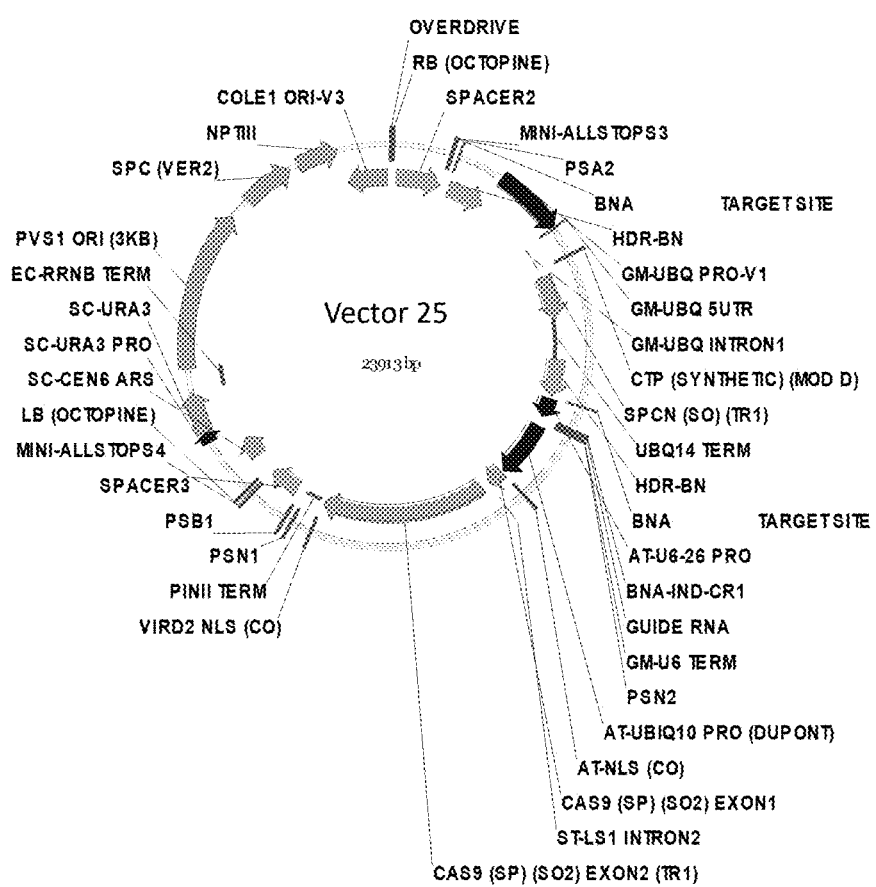

FIG. 40 depicts the vector map for Vector 25.

Figure 41:
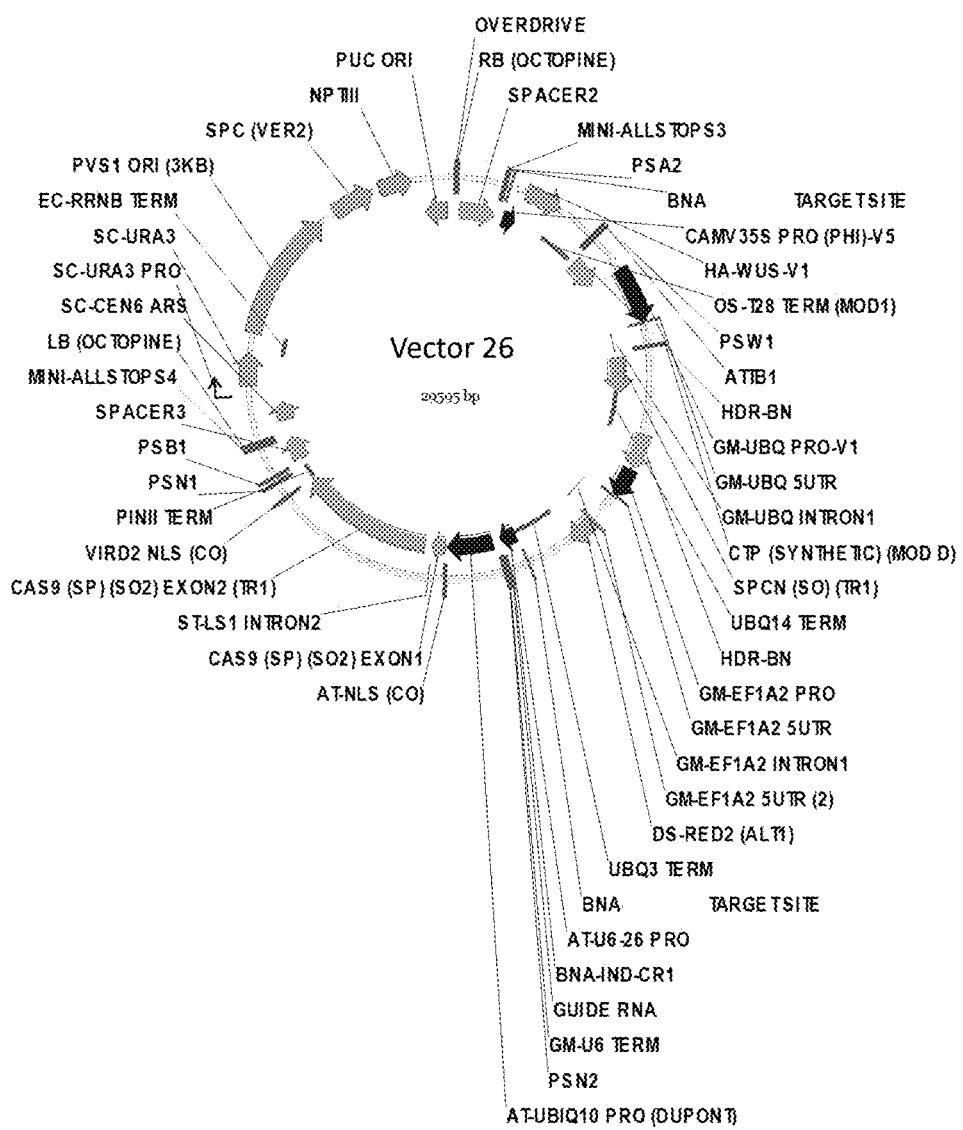

FIG. 41 depicts the vector map for Vector 26.

Figure 42:
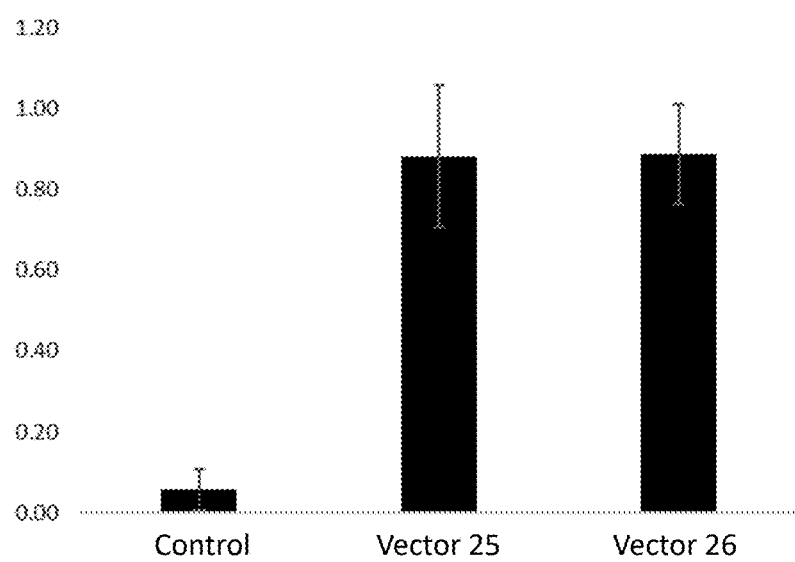

FIG. 42 shows the results for two different vectors, Vector 25 and Vector 26, demonstrating higher mutation rates as compared to a control vector with no flanking TS sequences.

Figure 43A:
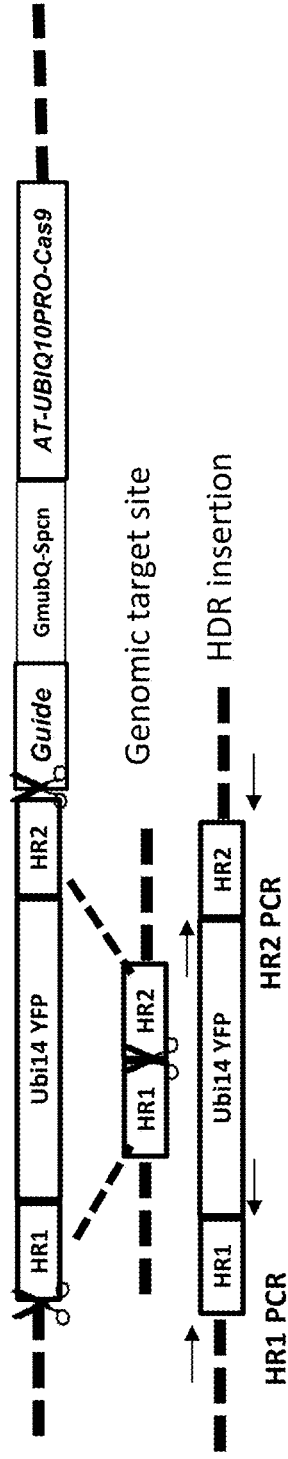
Figure 43B:
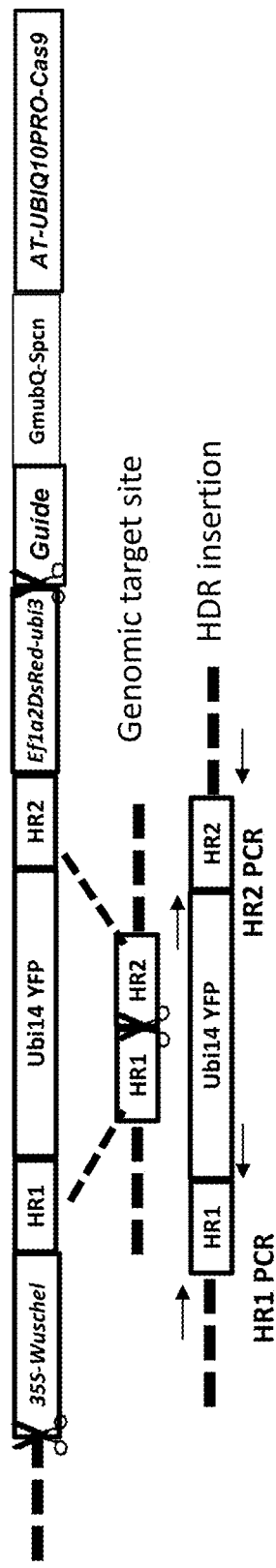

FIG. 43 depicts Canola SDN3 transformation vectors. FIG. 43A depicts the vector schematic and experimental design for Vector 27. FIG. 43B depicts the vector schematic and experimental strategy for Vector 28.

Figure 44:
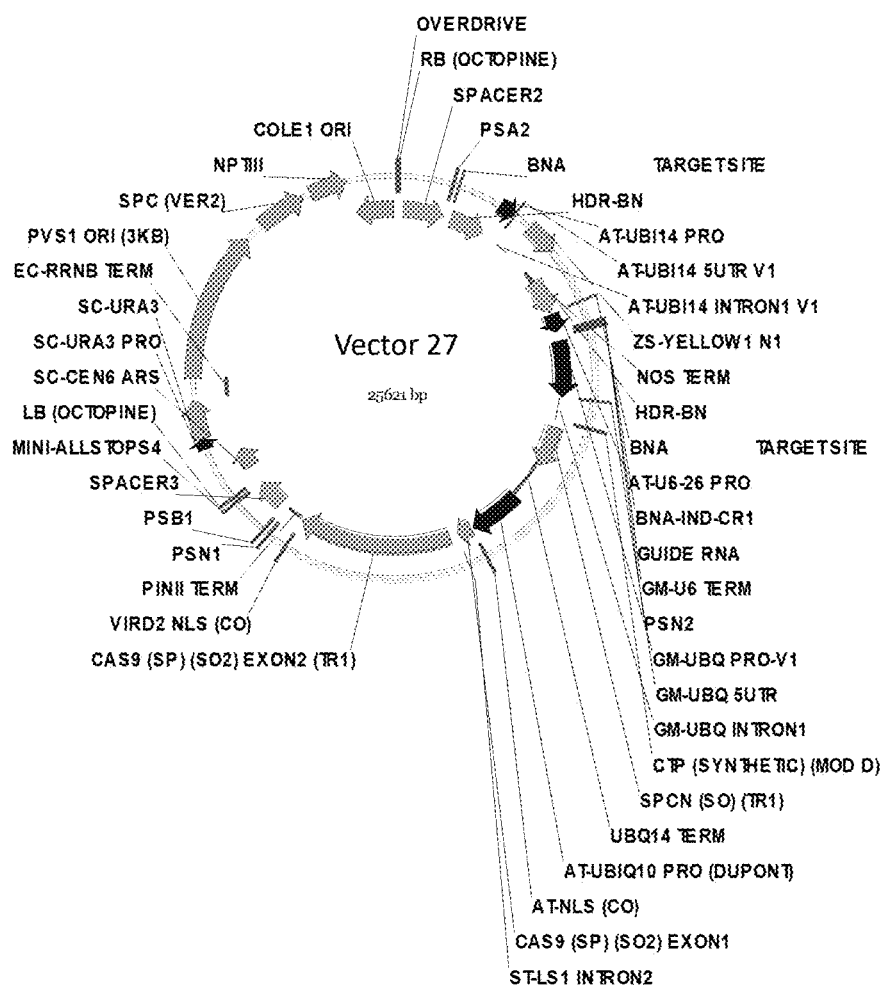

FIG. 44 depicts the vector map for Vector 27.

Figure 45:
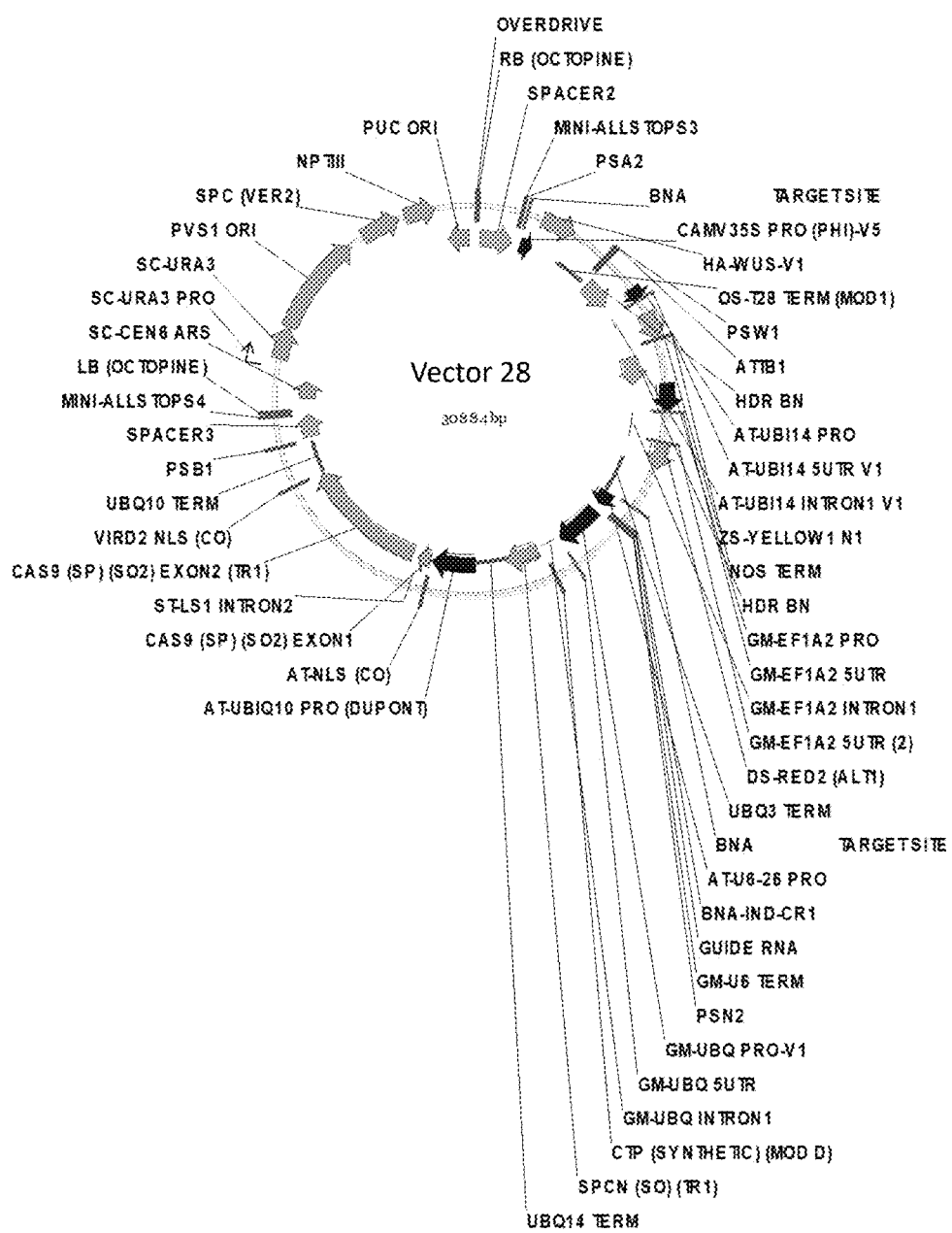

FIG. 45 depicts the vector map for Vector 28.

Figure 46:
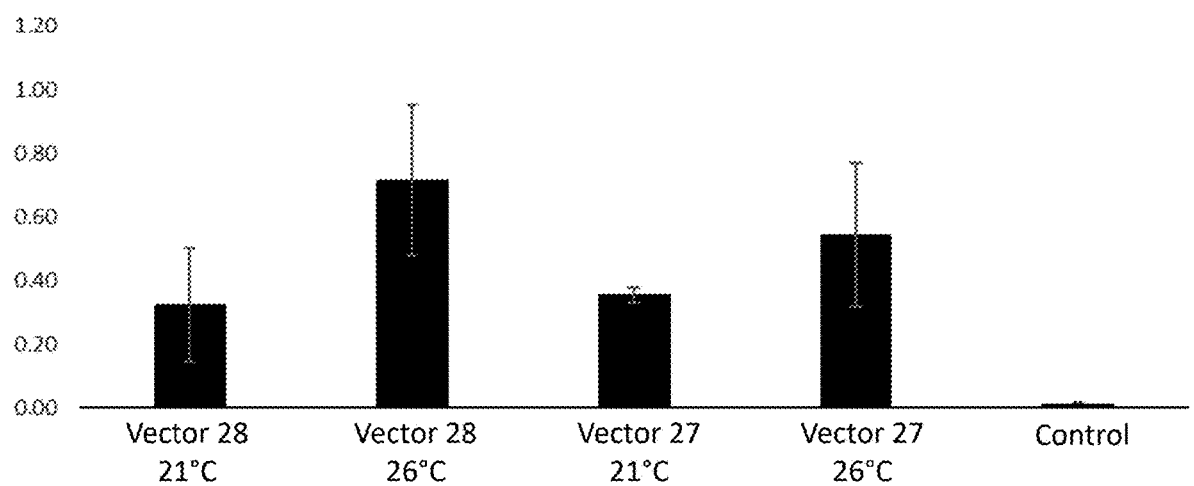

FIG. 46 shows results for Vector 27 and Vector 28 at two different temperatures.

Figure 47:
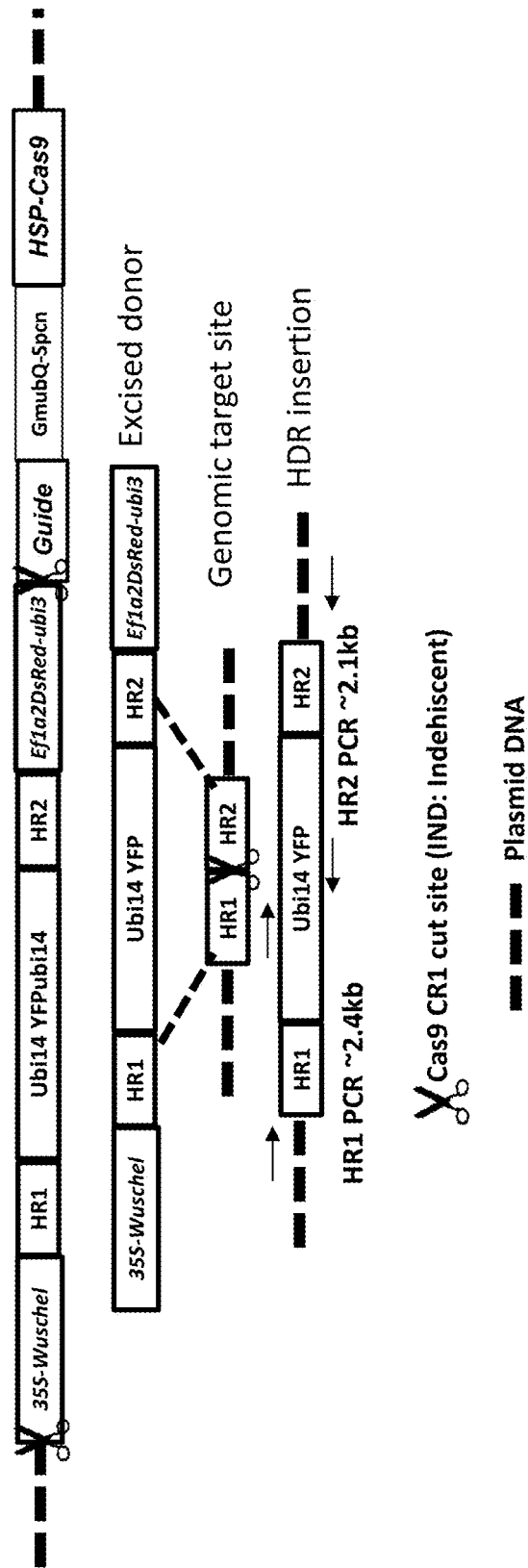

FIG. 47 depicts the vector schematic and experimental strategy for Canola SDN3 transformation vector Vector 29.

Figure 48:
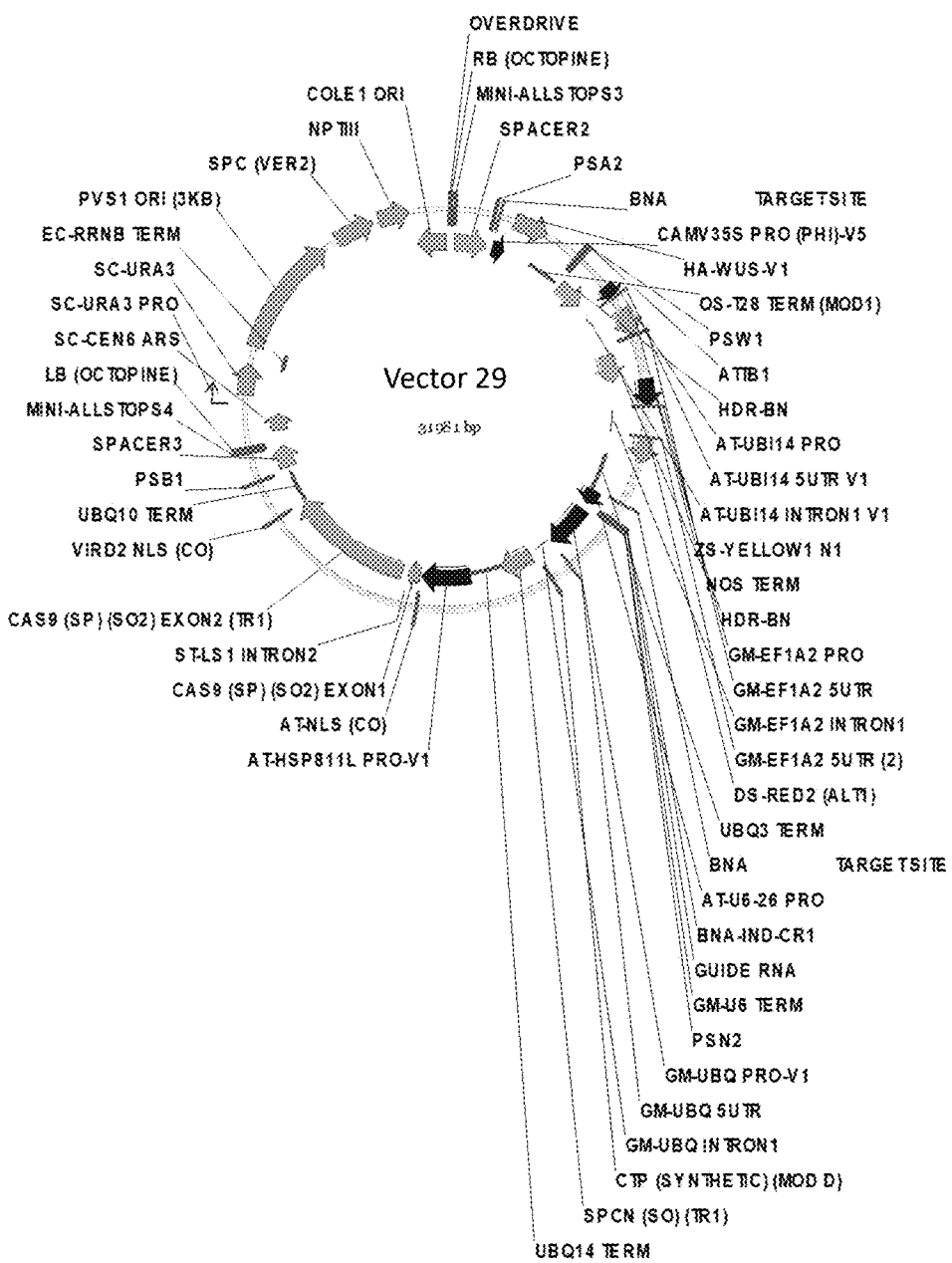

FIG. 48 depicts the vector map for Vector 29.

Figure 49:
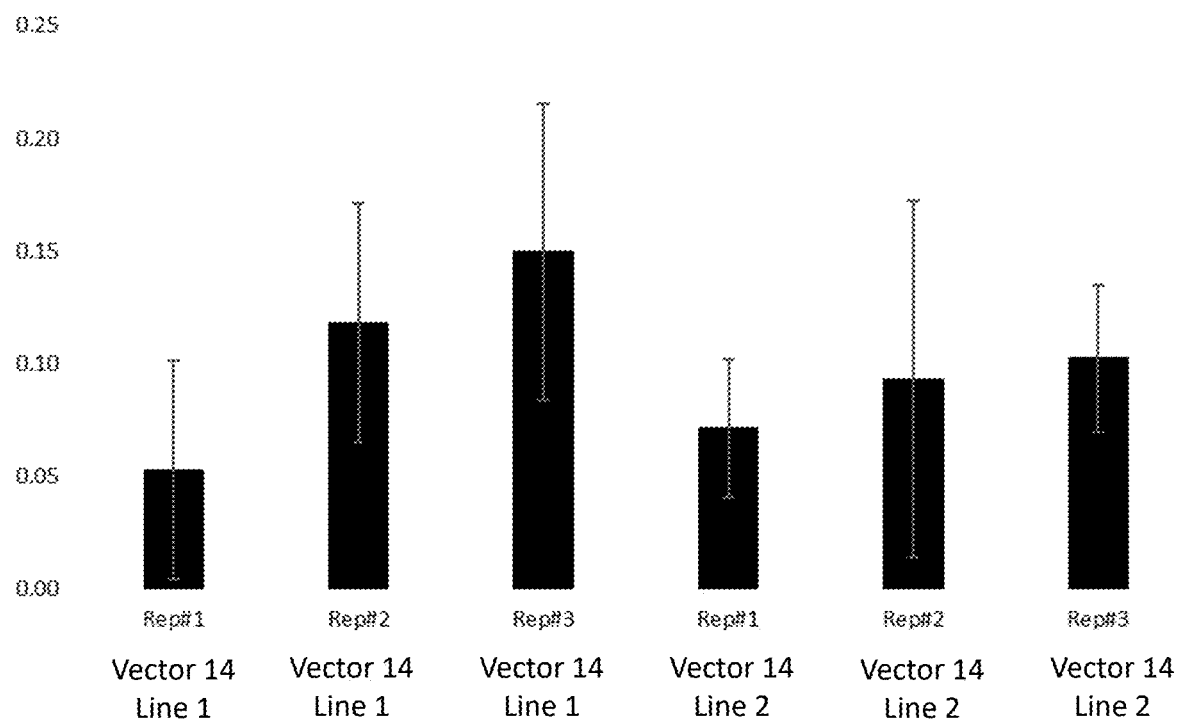

FIG. 49 shows the results for three reps of two different germplasm lines for Vector 14.

Figure 50:
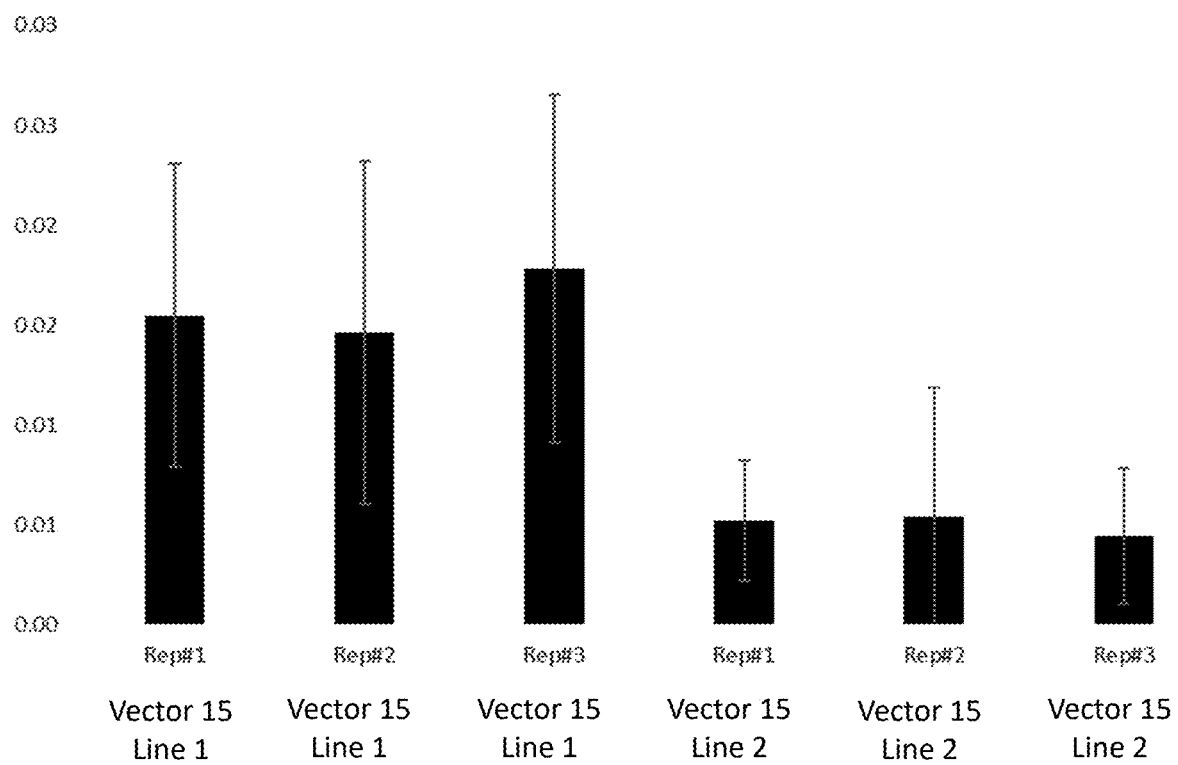

FIG. 50 shows the results for three reps of two different germplasm lines for Vector 15.

The sequence descriptions and sequence listing attached hereto comply with the rules governing nucleotide and amino acid sequence disclosures in patent applications as set forth in 37 C.F.R. §§ 1.821 and 1.825. The sequence descriptions comprise the three letter codes for amino acids as defined in 37 C.F.R. §§ 1.821 and 1.825, which are incorporated herein by reference.

SEQID NO:1 is the *Zea mays* DNA sequence of Zm-AXIG1 1.3 Kb PRO.

SEQID NO:2 is the *Zea mays* DNA sequence of Zm-WUS2 (ALT1).

SEQID NO:3 is the *Agrobacterium tumefaciens* DNA sequence of NOS terminator.

SEQID NO:4 is the *Zea mays* DNA sequence of ZM-PLTP PRO.

SEQID NO:5 is the *Zea mays* DNA sequence of ZM-PLTP 5'UTR.

SEQID NO:6 is the *Zea mays* DNA sequence of ZM-ODP2 (ALT1).

SEQID NO:7 is the *Oryza sativa* DNA sequence of OS-T28 TERM.

SEQID NO:8 is the *Zea mays* DNA sequence of UBI1ZM PRO.

SEQID NO:9 is the *Zea mays* DNA sequence of UBI1ZM 5'UTR.

SEQID NO:10 is the *Zea mays* DNA sequence of UBI1ZM INTRON1.

SEQ ID NO:11 is the Simian virus 40 DNA sequence of SV40 NLS.

SEQ ID NO:12 is the *Streptococcus pyogenes* DNA sequence of cas9 Exon1.

SEQ ID NO:13 is the *Solanum tuberosum* DNA sequence of ST-LS1 INTRON2.

SEQ ID NO:14 is the *Streptococcus pyogenes* DNA sequence of cas9 Exon2.

SEQ ID NO:15 is the *Agrobacterium tumefaciens* DNA sequence of VirD2 NLS.

SEQ ID NO:16 is the *Solanum tuberosum* DNA sequence of PINII terminator.

SEQ ID NO:17 is the *Zea mays* DNA sequence of ZM-U6 POLIII promoter.

SEQ ID NO:18 is the Artificial DNA sequence of gRNA tracrRNA.

SEQ ID NO:19 is the Artificial DNA sequence of cas9 gene sequence.

SEQ ID NO:20 is the *Zea mays* DNA sequence of ZM-ALS PRO.

SEQ ID NO:21 is the *Zea mays* DNA sequence of ZM-ALS (HRA) V2.

SEQ ID NO:22 is the *Sorghum bicolor* DNA sequence of SB-UBI terminator.

SEQ ID NO:23 is the DNA sequence of FL2 TERM (ALT1).

SEQ ID NO:24 is the DNA sequence of NPTII.

SEQ ID NO:25 is the *Zea mays* DNA sequence of CZ19B1 TERM.

SEQ ID NO:26 is the DNA sequence of PG47 PRO-V1.

SEQ ID NO:27 is the *Zea mays* DNA sequence of ZM-BT1 TP.

SEQ ID NO:28 is the *Zea mays* DNA sequence of ZM-AA1.

SEQ ID NO:29 is the *Zea mays* DNA sequence of IN2-1 TERM-V1.

SEQ ID NO:30 is the Artificial DNA sequence of gRNA crRNA for target site.

SEQ ID NO:31 is the Artificial DNA sequence of Target Site Sequence+PAM.

SEQ ID NO:32 is the *Zea mays* DNA sequence of Homology Region 1 Genotype A.

SEQ ID NO:33 is the *Zea mays* DNA sequence of Homology Region 2 Genotype A.

SEQ ID NO:34 is the *Zea mays* DNA sequence of Homology Region 1 Genotype B.

SEQ ID NO:35 is the *Zea mays* DNA sequence of Homology Region 2 Genotype B.

SEQ ID NO:36 is the *Zea mays* DNA sequence of Homology Region 1 Genotype C.

SEQ ID NO:37 is the *Zea mays* DNA sequence of Homology Region 2 Genotype C.

SEQ ID NO:38 is the Artificial DNA sequence of the Donor DNA of Vector 1.

SEQ ID NO:39 is the Artificial DNA sequence of the Donor DNA of Vector 2.

SEQ ID NO:40 is the Artificial DNA sequence of the Donor DNA of Vector 3.

SEQ ID NO:41 is the Artificial DNA sequence of the Donor DNA of Vector 4.

SEQ ID NO:42 is the Artificial DNA sequence of maize-optimized cas9 cassette.

SEQ ID NO:43 is the Simian virus 40 PRT sequence of SV40 NLS.

SEQ ID NO:44 is the *Agrobacterium tumefaciens* PRT sequence of VirD2 NLS.

SEQ ID NO:45 is the Artificial DNA sequence of pVIR9.

SEQ ID NO:46 is the Artificial DNA sequence of Vector 1.

SEQ ID NO:47 is the Artificial DNA sequence of Vector 2.

SEQ ID NO:48 is the Artificial DNA sequence of Vector 3.

SEQ ID NO:49 is the Artificial DNA sequence of Vector 4.

SEQ ID NO:50 is the Artificial DNA sequence of Vector 5.

SEQ ID NO:51 is the Artificial DNA sequence of Vector 6.

SEQ ID NO:52 is the *Streptococcus pyogenes* protein sequence of Cas9.

SEQ ID NO:53 is the Artificial DNA sequence of Vector 8.

SEQ ID NO:54 is the Artificial DNA sequence of Vector 9.

SEQ ID NO:55 is the Artificial DNA sequence of Vector 10.

SEQ ID NO:56 is the Artificial DNA sequence of Vector 11.

SEQ ID NO:57 is the Artificial DNA sequence of Vector 12.

SEQ ID NO:58 is the Artificial DNA sequence of Vector 13.

SEQ ID NO:59 is the Artificial DNA sequence of Vector 14.

SEQ ID NO:60 is the Artificial DNA sequence of Vector 15.

SEQ ID NO:61 is the Artificial DNA sequence of Vector 16.

SEQ ID NO:62 is the Artificial DNA sequence of Vector 17.

SEQ ID NO:63 is the Artificial DNA sequence of Vector 18.

SEQ ID NO:64 is the Artificial DNA sequence of Vector 19.

SEQ ID NO:65 is the Artificial DNA sequence of Vector 25.

SEQ ID NO:66 is the Artificial DNA sequence of Vector 26.

SEQ ID NO:67 is the Artificial DNA sequence of Vector 27.

SEQ ID NO:68 is the Artificial DNA sequence of Vector 28.

SEQ ID NO:69 is the Artificial DNA sequence of Vector 29.

SEQ ID NO:70 is the Artificial DNA sequence depicted in FIG. 10D for the SNP mutations of the target sequence.

SEQ ID NO:71 is the Artificial DNA sequence depicted in FIG. 15B for the first sequence, showing the target site.

SEQ ID NO:72 is the Artificial DNA sequence depicted in FIG. 15B for the second sequence showing the target site mutations.

SEQ ID NO:73 is the Artificial DNA sequence depicted in FIG. 30B for the WT soy sequence.

SEQ ID NO:74 is the Artificial DNA sequence depicted in FIG. 30B for the donor DNA for gRNA2.

DETAILED DESCRIPTION

Plant genome editing relies on either *Agrobacterium*- or particle gun (PG)-mediated delivery of all necessary components into the plant cell. Both delivery methods have their own advantages and limitations. *Agrobacterium*-mediated delivery approach has been demonstrated working well for gene knock-outs and gene deletions, which rely on non-homologous end joining (NHEJ) DNA repair pathway. However, for specific gene editing and targeted gene insertions, which are based on the homology-directed repair (HDR) pathway, this method was considered less favorable due to low copy number of T-DNA delivered to each infected cell resulting in very low frequencies of either edits or insertions. To overcome this deficiency, viral replication of donor DNA upon delivery has been demonstrated to increase frequency of targeted gene insertion (Baltes et al., 2014). However, this approach requires a complex vector design.

Particle bombardment, on the other hand, allows for a much higher copy number delivery but can result in a lower frequency of plant regeneration. Previously, it has been demonstrated that the use of morphogenic factors (e.g., ODP2, WUS) allowed an increase plant transformation and regeneration frequencies in both *Agrobacterium*- and particle bombardment-mediated experiments.

Multiple, co-delivered DNA vector molecules coding for different components, including Cas9 nuclease and guide RNA (gRNA), morphogenic factors (ODP2 and/or WUS), donor DNA, and a selectable marker gene, tend to co-integrate into the DSB site(s) through NHEJ repair pathway, thus significantly reducing the number of useful gene insertion events. The inventors herein conceived of developing new approaches related to delivery systems and vector configurations, which meaningfully increased both the frequency and quality of HDR-based gene integration events.

Terms used in the claims and specification are defined as set forth below unless otherwise specified. It must be noted that, as used in the specification and the appended claims, the singular forms "a," "an" and "the" include plural referents unless the context clearly dictates otherwise.

Definitions

As used herein, "nucleic acid" means a polynucleotide and includes a single or a double-stranded polymer of deoxyribonucleotide or ribonucleotide bases. Nucleic acids may also include fragments and modified nucleotides. Thus, the terms "polynucleotide", "nucleic acid sequence", "nucleotide sequence" and "nucleic acid fragment" are used interchangeably to denote a polymer of RNA and/or DNA and/or RNA-DNA that is single- or double-stranded, optionally comprising synthetic, non-natural, or altered nucleotide bases. Nucleotides (usually found in their 5'-monophosphate form) are referred to by their single letter designation as follows: "A" for adenosine or deoxyadenosine (for RNA or DNA, respectively), "C" for cytosine or deoxycytosine, "G" for guanosine or deoxyguanosine, "U" for uridine, "T" for deoxythymidine, "R" for purines (A or G), "Y" for pyrimidines (C or T), "K" for G or T, "H" for A or C or T, "I" for inosine, and "N" for any nucleotide.

The term "genome" as it applies to a prokaryotic and eukaryotic cell or organism cells encompasses not only chromosomal DNA found within the nucleus, but organelle DNA found within subcellular components (e.g., mitochondria, or plastid) of the cell.

"Open reading frame" is abbreviated ORF.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 80% sequence identity, or 90% sequence identity, up to and including 100% sequence identity (i.e., fully complementary) with each other.

The term "stringent conditions" or "stringent hybridization conditions" includes reference to conditions under which a probe will selectively hybridize to its target sequence in an in vitro hybridization assay. Stringent conditions are sequence-dependent and will be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of similarity are detected (heterologous probing). Generally, a probe is less than about 1000 nucleotides in length, optionally less than 500 nucleotides in length. Typically, stringent conditions will be those in which the salt concentration is less than about 1.5 M Na ion, typically about 0.01 to 1.0 M Na ion concentration (or other salt(s)) at pH 7.0 to 8.3, and at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2× SSC (20× SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1× SSC at 55 to 60° C. Exemplary high stringency conditions include hybridization in 50% formamide, 1 M NaCl, 1% SDS at 37° C., and a wash in 0.1× SSC at 60 to 65° C.

By "homology" is meant DNA sequences that are similar. For example, a "region of homology to a genomic region" that is found on the donor DNA is a region of DNA that has a similar sequence to a given "genomic region" in the cell or organism genome. A region of homology can be of any length that is sufficient to promote homologous recombination at the cleaved target site. For example, the region of homology can comprise at least 5-10, 5-15, 5-20, 5-25, 5-30, 5-35, 5-40, 5-45, 5-50, 5-55, 5-60, 5-65, 5-70, 5-75, 5-80, 5-85, 5-90, 5-95, 5-100, 5-200, 5-300, 5-400, 5-500, 5-600, 5-700, 5-800, 5-900, 5-1000, 5-1100, 5-1200, 5-1300, 5-1400, 5-1500, 5-1600, 5-1700, 5-1800, 5-1900, 5-2000, 5-2100, 5-2200, 5-2300, 5-2400, 5-2500, 5-2600, 5-2700, 5-2800, 5-2900, 5-3000, 5-3100 or more bases in length such that the region of homology has sufficient homology to undergo homologous recombination with the corresponding genomic region. "Sufficient homology" indicates that two polynucleotide sequences have structural similarity such that they are capable of acting as substrates for a homologous recombination reaction. The structural similarity includes overall length of each polynucleotide fragment, as well as the sequence similarity of the polynucleotides. Sequence similarity can be described by the percent sequence identity over the whole length of the sequences, and/or by conserved regions comprising localized similarities such as contiguous nucleotides having 100% sequence identity, and percent sequence identity over a portion of the length of the sequences.

As used herein, a "genomic region" is a segment of a chromosome in the genome of a cell that is present on either side of the target site or, alternatively, also comprises a portion of the target site. The genomic region can comprise at least 5-10, 5-15, 5-20, 5-25, 5-30, 5-35, 5-40, 5-45, 5-50, 5-55, 5-60, 5-65, 5-70, 5-75, 5-80, 5-85, 5-90, 5-95, 5-100, 5-200, 5-300, 5-400, 5-500, 5-600, 5-700, 5-800, 5-900, 5-1000, 5-1100, 5-1200, 5-1300, 5-1400, 5-1500, 5-1600, 5-1700, 5-1800, 5-1900, 5-2000, 5-2100, 5-2200, 5-2300, 5-2400, 5-2500, 5-2600, 5-2700, 5-2800, 5-2900, 5-3000, 5-3100 or more bases such that the genomic region has sufficient homology to undergo homologous recombination with the corresponding region of homology.

As used herein, "homologous recombination" (HR) includes the exchange of DNA fragments between two DNA molecules at the sites of homology. The frequency of homologous recombination is influenced by a number of factors. Different organisms vary with respect to the amount of homologous recombination and the relative proportion of homologous to non-homologous recombination. Generally, the length of the region of homology affects the frequency of homologous recombination events: the longer the region of homology, the greater the frequency. The length of the homology region needed to observe homologous recombination is also species-variable. In many cases, at least 5 kb of homology has been utilized, but homologous recombination has been observed with as little as 25-50 bp of homology. See, for example, Singer et al., (1982) Cell 31:25-33; Shen and Huang, (1986) Genetics 112:441-57; Watt et al., (1985) *Proc. Natl. Acad. Sci. USA* 82:4768-72, Sugawara and Haber, (1992) *Mol Cell Biol* 12:563-75, Rubnitz and Subramani, (1984) *Mol Cell Biol* 4:2253-8; Ayares et al., (1986) *Proc. Natl. Acad. Sci. USA* 83:5199-203; Liskay et al., (1987) *Genetics* 115:161-7.

"Sequence identity" or "identity" in the context of nucleic acid or polypeptide sequences refers to the nucleic acid bases or amino acid residues in two sequences that are the same when aligned for maximum correspondence over a specified comparison window.

The term "percentage of sequence identity" refers to the value determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the results by 100 to yield the percentage of sequence identity. Useful examples of percent sequence identities include, but are not limited to, 50%, 55%, 60%, 65%, 70%, 75%, 80%, 85%, 90%, or 95%, or any percentage from 50% to 100%. These identities can be determined using any of the programs described herein.

Sequence alignments and percent identity or similarity calculations may be determined using a variety of comparison methods designed to detect homologous sequences including, but not limited to, the MegAlign™ program of the LASERGENE bioinformatics computing suite (DNASTAR Inc., Madison, WI). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

The "Clustal V method of alignment" corresponds to the alignment method labeled Clustal V (described by Higgins and Sharp, (1989) *CABIOS* 5:151-153; Higgins et al., (1992) *Comput Appl Biosci* 8:189-191) and found in the MegAlign™ program of the LASERGENE bioinformatics computing suite (DNASTAR Inc., Madison, WI). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. The "Clustal W method of alignment" corresponds to the alignment method labeled Clustal W (described by Higgins and Sharp, (1989) *CABIOS* 5:151-153; Higgins et al., (1992) *Comput Appl Biosci* 8:189-191) and found in the MegAlign™ v6.1 program of the LASERGENE bioinformatics computing suite (DNASTAR Inc., Madison, WI). Default parameters for multiple alignment (GAP PENALTY=10, GAP LENGTH PENALTY=0.2, Delay Divergen Seqs (%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program. Unless otherwise stated, sequence identity/similarity values provided herein refer to the value obtained using GAP Version 10 (GCG, Accelrys, San Diego, CA) using the following parameters: % identity and % similarity for a nucleotide sequence using a gap creation penalty weight of 50 and a gap length extension penalty weight of 3, and the nwsgapdna.cmp scoring matrix; % identity and % similarity for an amino acid sequence using a GAP creation penalty weight of 8 and a gap length extension penalty of 2, and the BLOSUM62 scoring matrix (Henikoff and Henikoff, (1989) *Proc. Natl. Acad. Sci. USA* 89:10915). GAP uses the algorithm of Needleman and Wunsch, (1970) *J Mol Biol* 48:443-53, to find an alignment of two complete sequences that maximizes the number of matches and minimizes the number of gaps. GAP considers all possible alignments and gap positions and creates the alignment with the largest number of matched bases and the fewest gaps, using a gap creation penalty and a gap extension penalty in units of matched bases. "BLAST" is a searching algorithm provided by the National Center for Biotechnology Information (NCBI) used to find regions of similarity between biological sequences. The program compares nucleotide or protein sequences to sequence databases and calculates the statistical significance of matches to identify sequences having sufficient similarity to a query sequence such that the similarity would not be predicted to have occurred randomly. BLAST reports the identified sequences and their local alignment to the query sequence. It is well understood by one skilled in the art that many levels of sequence identity are useful in identifying polypeptides from other species or modified naturally or synthetically wherein such polypeptides have the same or similar function or activity. Useful examples of percent identities include, but are not limited to, 50%, 55%, 60%, 65%, 70%, 75%, 80%, 85%, 90% or 95%, or any percentage from 50% to 100%. Indeed, any amino acid identity from 50% to 100% may be useful in describing the present disclosure, such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%.

Polynucleotide and polypeptide sequences, variants thereof, and the structural relationships of these sequences can be described by the terms "homology", "homologous", "substantially identical", "substantially similar" and "corresponding substantially" which are used interchangeably herein. These refer to polypeptide or nucleic acid sequences wherein changes in one or more amino acids or nucleotide bases do not affect the function of the molecule, such as the ability to mediate gene expression or to produce a certain phenotype. These terms also refer to modification(s) of nucleic acid sequences that do not substantially alter the functional properties of the resulting nucleic acid relative to the initial, unmodified nucleic acid. These modifications include deletion, substitution, and/or insertion of one or more nucleotides in the nucleic acid fragment. Substantially similar nucleic acid sequences encompassed may be defined by their ability to hybridize (under moderately stringent conditions, e.g., 0.5× SSC, 0.1% SDS, 60° C.) with the sequences exemplified herein, or to any portion of the nucleotide sequences disclosed herein and which are functionally equivalent to any of the nucleic acid sequences disclosed herein. Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

A "centimorgan" (cM) or "map unit" is the distance between two polynucleotide sequences, linked genes, markers, target sites, loci, or any pair thereof, wherein 1% of the products of meiosis are recombinant. Thus, a centimorgan is equivalent to a distance equal to a 1% average recombination frequency between the two linked genes, markers, target sites, loci, or any pair thereof.

An "isolated" or "purified" nucleic acid molecule, polynucleotide, polypeptide, or protein, or biologically active portion thereof, is substantially or essentially free from components that normally accompany or interact with the polynucleotide or protein as found in its naturally occurring environment. Thus, an isolated or purified polynucleotide or polypeptide or protein is substantially free of other cellular material, or culture medium when produced by recombinant techniques, or substantially free of chemical precursors or other chemicals when chemically synthesized. Optimally, an "isolated" polynucleotide is free of sequences (optimally protein encoding sequences) that naturally flank the polynucleotide (i.e., sequences located at the 5' and 3' ends of the polynucleotide) in the genomic DNA of the organism from which the polynucleotide is derived. For example, in various embodiments, the isolated polynucleotide can contain less than about 5 kb, 4 kb, 3 kb, 2 kb, 1 kb, 0.5 kb, or 0.1 kb of nucleotide sequence that naturally flank the polynucleotide in genomic DNA of the cell from which the polynucleotide is derived. Isolated polynucleotides may be purified from a cell in which they naturally occur. Conventional nucleic acid purification methods known to skilled artisans may be used to obtain isolated polynucleotides. The term also embraces recombinant polynucleotides and chemically synthesized polynucleotides.

The term "fragment" refers to a contiguous set of nucleotides or amino acids. In one embodiment, a fragment is 2, 3, 4, 5, 6, 7, 8, 9, 10, 11, 12, 13, 14, 15, 16, 17, 18, 19, 20, or greater than 20 contiguous nucleotides. In one embodiment, a fragment is 2, 3, 4, 5, 6, 7, 8, 9, 10, 11, 12, 13, 14, 15, 16, 17, 18, 19, 20, or greater than 20 contiguous amino acids. A fragment may or may not exhibit the function of a sequence sharing some percent identity over the length of said fragment.

The terms "fragment that is functionally equivalent" and "functionally equivalent fragment" are used interchangeably herein. These terms refer to a portion or subsequence of an isolated nucleic acid fragment or polypeptide that displays the same activity or function as the longer sequence from which it derives. In one example, the fragment retains the ability to alter gene expression or produce a certain phenotype whether or not the fragment encodes an active protein. For example, the fragment can be used in the design of genes to produce the desired phenotype in a modified plant. Genes can be designed for use in suppression by linking a nucleic acid fragment, whether or not it encodes an active enzyme, in the sense or antisense orientation relative to a plant promoter sequence.

"Gene" includes a nucleic acid fragment that expresses a functional molecule such as, but not limited to, a specific protein, including regulatory sequences preceding (5' non-coding sequences) and following (3' non-coding sequences) the coding sequence. "Native gene" refers to a gene as found in its natural endogenous location with its own regulatory sequences.

By the term "endogenous" it is meant a sequence or other molecule that naturally occurs in a cell or organism. In one aspect, an endogenous polynucleotide is normally found in the genome of a cell; that is, not heterologous.

An "allele" is one of several alternative forms of a gene occupying a given locus on a chromosome. When all the alleles present at a given locus on a chromosome are the same, that plant is homozygous at that locus. If the alleles present at a given locus on a chromosome differ, that plant is heterozygous at that locus.

"Coding sequence" refers to a polynucleotide sequence which codes for a specific amino acid sequence. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences include, but are not limited to, promoters, translation leader sequences, 5' untranslated sequences, 3' untranslated sequences, introns, polyadenylation target sequences, RNA processing sites, effector binding sites, and stem-loop structures.

A "mutated gene" is a gene that has been altered through human intervention. Such a "mutated gene" has a sequence that differs from the sequence of the corresponding non-mutated gene by at least one nucleotide addition, deletion, or substitution. In certain embodiments of the disclosure, the mutated gene comprises an alteration that results from a guide polynucleotide/Cas endonuclease system as disclosed herein. A mutated plant is a plant comprising a mutated gene.

As used herein, a "targeted mutation" is a mutation in a gene (referred to as the target gene), including a native gene, that was made by altering a target sequence within the target gene using any method known to one skilled in the art, including a method involving a guided Cas endonuclease system as disclosed herein.

The terms "knock-out", "gene knock-out" and "genetic knock-out" are used interchangeably herein. A knock-out represents a DNA sequence of a cell that has been rendered partially or completely inoperative by targeting with a Cas protein; for example, a DNA sequence prior to knock-out could have encoded an amino acid sequence, or could have had a regulatory function (e.g., promoter).

The terms "knock-in", "gene knock-in, "gene insertion" and "genetic knock-in" are used interchangeably herein. A knock-in represents the replacement or insertion of a DNA sequence at a specific DNA sequence in cell by targeting with a Cas protein (for example by homologous recombination (HR), wherein a suitable donor DNA polynucleotide is also used). Examples of knock-ins are a specific insertion of a heterologous amino acid coding sequence in a coding region of a gene, or a specific insertion of a transcriptional regulatory element in a genetic locus.

By "domain" it is meant a contiguous stretch of nucleotides (that can be RNA, DNA, and/or RNA-DNA-combination sequence) or amino acids.

The term "conserved domain" or "motif" means a set of polynucleotides or amino acids conserved at specific positions along an aligned sequence of evolutionarily related proteins. While amino acids at other positions can vary between homologous proteins, amino acids that are highly conserved at specific positions indicate amino acids that are essential to the structure, the stability, or the activity of a protein. Because they are identified by their high degree of conservation in aligned sequences of a family of protein homologues, they can be used as identifiers, or "signatures", to determine if a protein with a newly determined sequence belongs to a previously identified protein family.

A "codon-modified gene" or "codon-preferred gene" or "codon-optimized gene" is a gene having its frequency of codon usage designed to mimic the frequency of preferred codon usage of the host cell.

An "optimized" polynucleotide is a sequence that has been optimized for improved expression in a particular heterologous host cell.

A "plant-optimized nucleotide sequence" is a nucleotide sequence that has been optimized for expression in plants, particularly for increased expression in plants. A plant-optimized nucleotide sequence includes a codon-optimized gene. A plant-optimized nucleotide sequence can be synthesized by modifying a nucleotide sequence encoding a protein such as, for example, a Cas endonuclease as disclosed herein, using one or more plant-preferred codons for improved expression. See, for example, Campbell and Gowri (1990) *Plant Physiol.* 92:1-11 for a discussion of host-preferred codon usage.

A "promoter" is a region of DNA involved in recognition and binding of RNA polymerase and other proteins to initiate transcription. The promoter sequence consists of proximal and more distal upstream elements, the latter elements often referred to as enhancers. An "enhancer" is a DNA sequence that can stimulate promoter activity, and may be an innate element of the promoter or a heterologous element inserted to enhance the level or tissue-specificity of a promoter. Promoters may be derived in their entirety from a native gene, or be composed of different elements derived from different promoters found in nature, and/or comprise synthetic DNA segments. It is understood by those skilled in the art that different promoters may direct the expression of a gene in different tissues or cell types, or at different stages of development, or in response to different environmental conditions. It is further recognized that since in most cases the exact boundaries of regulatory sequences have not been completely defined, DNA fragments of some variation may have identical promoter activity.

Promoters that cause a gene to be expressed in most cell types at most times are commonly referred to as "constitutive promoters". The term "inducible promoter" refers to a promoter that selectively express a coding sequence or functional RNA in response to the presence of an endogenous or exogenous stimulus, for example by chemical compounds (chemical inducers) or in response to environmental, hormonal, chemical, and/or developmental signals. Inducible or regulated promoters include, for example, promoters induced or regulated by light, heat, stress, flooding or drought, salt stress, osmotic stress, phytohormones, wounding, or chemicals such as ethanol, abscisic acid (ABA), jasmonate, salicylic acid, or safeners.

"Translation leader sequence" refers to a polynucleotide sequence located between the promoter sequence of a gene and the coding sequence. The translation leader sequence is present in the mRNA upstream of the translation start sequence. The translation leader sequence may affect processing of the primary transcript to mRNA, mRNA stability or translation efficiency. Examples of translation leader sequences have been described (e.g., Turner and Foster, (1995) *Mol Biotechnol* 3:225-236).

"3' non-coding sequences", "transcription terminator" or "termination sequences" refer to DNA sequences located downstream of a coding sequence and include polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The use of different 3' non-coding sequences is exemplified by Ingelbrecht et al., (1989) *Plant Cell* 1:671-680.

"RNA transcript" refers to the product resulting from RNA polymerase-catalyzed transcription of a DNA sequence. When the RNA transcript is a perfect complimentary copy of the DNA sequence, it is referred to as the primary transcript or pre-mRNA. A RNA transcript is referred to as the mature RNA or mRNA when it is a RNA sequence derived from post-transcriptional processing of the primary transcript pre-mRNA. "Messenger RNA" or "mRNA" refers to the RNA that is without introns and that can be translated into protein by the cell. "cDNA" refers to a DNA that is complementary to, and synthesized from, an mRNA template using the enzyme reverse transcriptase. The cDNA can be single-stranded or converted into double-stranded form using the Klenow fragment of DNA polymerase I. "Sense" RNA refers to RNA transcript that includes the mRNA and can be translated into protein within a cell or in vitro. "Antisense RNA" refers to an RNA transcript that is complementary to all or part of a target primary transcript or mRNA, and that blocks the expression of a target gene (see, e.g., U.S. Pat. No. 5,107,065). The complementarity of an antisense RNA may be with any part of the specific gene transcript, i.e., at the 5' non-coding sequence, 3' non-coding sequence, introns, or the coding sequence. "Functional RNA" refers to antisense RNA, ribozyme RNA, or other RNA that may not be translated but yet has an effect on cellular processes. The terms "complement" and "reverse complement" are used interchangeably herein with respect to mRNA transcripts, and are meant to define the antisense RNA of the message.

The term "genome" refers to the entire complement of genetic material (genes and non-coding sequences) that is present in each cell of an organism, or virus or organelle; and/or a complete set of chromosomes inherited as a (haploid) unit from one parent.

The term "operably linked" refers to the association of nucleic acid sequences on a single nucleic acid fragment so that the function of one is regulated by the other. For example, a promoter is operably linked with a coding sequence when it is capable of regulating the expression of that coding sequence (i.e., the coding sequence is under the transcriptional control of the promoter). Coding sequences can be operably linked to regulatory sequences in a sense or antisense orientation. In another example, the complementary RNA regions can be operably linked, either directly or indirectly, 5' to the target mRNA, or 3' to the target mRNA, or within the target mRNA, or a first complementary region is 5' and its complement is 3' to the target mRNA.

Generally, "host" refers to an organism or cell into which a heterologous component (polynucleotide, polypeptide, other molecule, cell) has been introduced. As used herein, a "host cell" refers to an in vivo or in vitro eukaryotic cell, prokaryotic cell (e.g., bacterial or archaeal cell), or cell from a multicellular organism (e.g., a cell line) cultured as a unicellular entity, into which a heterologous polynucleotide or polypeptide has been introduced. In some embodiments, the cell is selected from the group consisting of: an archaeal cell, a bacterial cell, a eukaryotic cell, a eukaryotic single-cell organism, a somatic cell, a germ cell, a stem cell, a plant cell, an algal cell, an animal cell, in invertebrate cell, a vertebrate cell, a fish cell, a frog cell, a bird cell, an insect cell, a mammalian cell, a pig cell, a cow cell, a goat cell, a sheep cell, a rodent cell, a rat cell, a mouse cell, a non-human primate cell, and a human cell. In some cases, the cell is in vitro. In some cases, the cell is in vivo.

The term "recombinant" refers to an artificial combination of two otherwise separated segments of sequence, e.g., by chemical synthesis, or manipulation of isolated segments of nucleic acids by genetic engineering techniques.

The terms "plasmid", "vector" and "cassette" refer to a linear or circular extra chromosomal element often carrying genes that are not part of the central metabolism of the cell, and usually in the form of double-stranded DNA. Such elements may be autonomously replicating sequences, genome integrating sequences, phage, or nucleotide sequences, in linear or circular form, of a single- or double-stranded DNA or RNA, derived from any source, in which a number of nucleotide sequences have been joined or recombined into a unique construction which is capable of introducing a polynucleotide of interest into a cell. "Transformation cassette" refers to a specific vector comprising a gene and having elements in addition to the gene that facilitates transformation of a particular host cell. "Expression cassette" refers to a specific vector comprising a gene and having elements in addition to the gene that allow for expression of that gene in a host. In one aspect, a "Donor DNA cassette" comprises a heterologous polynucleotide to be inserted at the double-strand break site created by a double-strand-break inducing agent (e.g. a Cas endonuclease and guide RNA complex), that is operably linked to a noncoding expression regulatory element. In some aspects, the Donor DNA cassette further comprises polynucleotide sequences that are homologous to the target site, that flank the polynucleotide of interest operably linked to a noncoding expression regulatory element.

The terms "recombinant DNA molecule", "recombinant DNA construct", "expression construct", "construct", and "recombinant construct" are used interchangeably herein. A recombinant DNA construct comprises an artificial combination of nucleic acid sequences, e.g., regulatory and coding sequences that are not all found together in nature. For example, a recombinant DNA construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to introduce the vector into the host cells as is well known to those skilled in the art. For example, a plasmid vector can be used. The skilled artisan is well aware of the genetic elements that must be present on the vector in order to successfully transform, select and propagate host cells. The skilled artisan will also recognize that different independent transformation events may result in different levels and patterns of expression (Jones et al., (1985) *EMBO J* 4:2411-2418; De Almeida et al., (1989) *Mol Gen Genetics* 218:78-86), and thus that multiple events are typically screened in order to obtain lines displaying the desired expression level and pattern. Such screening may be accomplished standard molecular biological, biochemical, and other assays including Southern analysis of DNA, Northern analysis of mRNA expression, PCR, real time quantitative PCR (qPCR), reverse transcription PCR (RT-PCR), immunoblotting analysis of protein expression, enzyme or activity assays, and/or phenotypic analysis.

The term "heterologous" refers to the difference between the original environment, location, or composition of a particular polynucleotide or polypeptide sequence and its current environment, location, or composition. Non-limiting examples include differences in taxonomic derivation (e.g., a polynucleotide sequence obtained from *Zea mays* would be heterologous if inserted into the genome of an *Oryza sativa* plant, or of a different variety or cultivar of *Zea mays*; or a polynucleotide obtained from a bacterium was introduced into a cell of a plant), or sequence (e.g., a polynucleotide sequence obtained from *Zea mays*, isolated, modified, and re-introduced into a maize plant). As used herein, "heterologous" in reference to a sequence can refer to a sequence that originates from a different species, variety, foreign species, or, if from the same species, is substantially modified from its native form in composition and/or genomic locus by deliberate human intervention. For example, a promoter operably linked to a heterologous polynucleotide is from a species different from the species from which the polynucleotide was derived, or, if from the same/analogous species, one or both are substantially modified from their original form and/or genomic locus, or the promoter is not the native promoter for the operably linked polynucleotide. Alternatively, one or more regulatory region(s) and/or a polynucleotide provided herein may be entirely synthetic.

The term "expression", as used herein, refers to the production of a functional end-product (e.g., an mRNA, guide RNA, or a protein) in either precursor or mature form.

A "mature" protein refers to a post-translationally processed polypeptide (i.e., one from which any pre- or propeptides present in the primary translation product have been removed).

"Precursor" protein refers to the primary product of translation of mRNA (i.e., with pre- and propeptides still present). Pre- and propeptides may be but are not limited to intracellular localization signals.

"CRISPR" (Clustered Regularly Interspaced Short Palindromic Repeats) loci refers to certain genetic loci encoding components of DNA cleavage systems, for example, used by bacterial and archaeal cells to destroy foreign DNA (Horvath and Barrangou, 2010, *Science* 327:167-170; WO2007025097, published 1 Mar. 2007). A CRISPR locus can consist of a CRISPR array, comprising short direct repeats (CRISPR repeats) separated by short variable DNA sequences (called spacers), which can be flanked by diverse Cas (CRISPR-associated) genes.

As used herein, an "effector" or "effector protein" is a protein that encompasses an activity including recognizing, binding to, and/or cleaving or nicking a polynucleotide target. An effector, or effector protein, may also be an endonuclease. The "effector complex" of a CRISPR system includes Cas proteins involved in crRNA and target recognition and binding. Some of the component Cas proteins may additionally comprise domains involved in target polynucleotide cleavage.

The term "Cas protein" refers to a polypeptide encoded by a Cas (CRISPR-associated) gene. A Cas protein includes but is not limited to: a Cas9 protein, a Cpf1 (Cas12) protein, a C2c1 protein, a C2c2 protein, a C2c3 protein, Cas3, Cas3-HD, Cas 5, Cas7, Cas8, Cas10, or combinations or complexes of these. A Cas protein may be a "Cas endonuclease" or "Cas effector protein", that when in complex with a suitable polynucleotide component, is capable of recognizing, binding to, and optionally nicking or cleaving all or part of a specific polynucleotide target sequence. A Cas endonuclease described herein comprises one or more nuclease domains. The endonucleases of the disclosure may include those having one or more RuvC nuclease domains. A Cas protein is further defined as a functional fragment or functional variant of a native Cas protein, or a protein that shares at least 50%, between 50% and 55%, at least 55%, between 55% and 60%, at least 60%, between 60% and 65%, at least 65%, between 65% and 70%, at least 70%, between 70% and 75%, at least 75%, between 75% and 80%, at least 80%, between 80% and 85%, at least 85%, between 85% and 90%, at least 90%, between 90% and 95%, at least 95%, between 95% and 96%, at least 96%, between 96% and 97%, at least 97%, between 97% and 98%, at least 98%, between 98% and 99%, at least 99%, between 99% and 100%, or 100% sequence identity with at least 50, between 50 and 100, at least 100, between 100 and 150, at least 150, between 150 and 200, at least 200, between 200 and 250, at least 250, between 250 and 300, at least 300, between 300 and 350, at least 350, between 350 and 400, at least 400, between 400 and 450, at least 500, or greater than 500 contiguous amino acids of a native Cas protein, and retains at least partial activity.

A "Cas endonuclease" may comprise domains that enable it to function as a double-strand-break-inducing agent. A "Cas endonuclease" may also comprise one or more modifications or mutations that abolish or reduce its ability to cleave a double-strand polynucleotide (dCas). In some aspects, the Cas endonuclease molecule may retain the ability to nick a single-strand polynucleotide (for example, a D10A mutation in a Cas9 endonuclease molecule) (nCas9).

A "functional fragment", "fragment that is functionally equivalent" and "functionally equivalent fragment" of a Cas endonuclease are used interchangeably herein, and refer to a portion or subsequence of the Cas endonuclease of the present disclosure in which the ability to recognize, bind to, and optionally unwind, nick or cleave (introduce a single or double-strand break in) the target site is retained. The portion or subsequence of the Cas endonuclease can comprise a complete or partial (functional) peptide of any one of its domains such as for example, but not limiting to a complete of functional part of a Cas3 HD domain, a complete of functional part of a Cas3 Helicase domain, complete of functional part of a Cascade protein (such as but not limiting to a Cas5, Cas5d, Cas7 and Cas8b1).

The terms "functional variant", "variant that is functionally equivalent" and "functionally equivalent variant" of a Cas endonuclease or Cas effector protein are used interchangeably herein, and refer to a variant of the Cas effector protein disclosed herein in which the ability to recognize, bind to, and optionally unwind, nick or cleave all or part of a target sequence is retained.

A Cas endonuclease may also include a multifunctional Cas endonuclease. The term "multifunctional Cas endonuclease" and "multifunctional Cas endonuclease polypeptide" are used interchangeably herein and includes reference to a single polypeptide that has Cas endonuclease functionality (comprising at least one protein domain that can act as a Cas endonuclease) and at least one other functionality, such as but not limited to, the functionality to form a cascade (comprises at least a second protein domain that can form a cascade with other proteins). In one aspect, the multifunctional Cas endonuclease comprises at least one additional protein domain relative (either internally, upstream (5'), downstream (3'), or both internally 5' and 3', or any combination thereof) to those domains typical of a Cas endonuclease.

The terms "cascade" and "cascade complex" are used interchangeably herein and include reference to a multi-subunit protein complex that can assemble with a polynucleotide forming a polynucleotide-protein complex (PNP). Cascade is a PNP that relies on the polynucleotide for complex assembly and stability, and for the identification of target nucleic acid sequences. Cascade functions as a surveillance complex that finds and optionally binds target nucleic acids that are complementary to a variable targeting domain of the guide polynucleotide.

The terms "cleavage-ready Cascade", "crCascade", "cleavage-ready Cascade complex", "crCascade complex", "cleavage-ready Cascade system", "CRC" and "crCascade system", are used interchangeably herein and include reference to a multi-subunit protein complex that can assemble with a polynucleotide forming a polynucleotide-protein complex (PNP), wherein one of the cascade proteins is a Cas endonuclease capable of recognizing, binding to, and optionally unwinding, nicking, or cleaving all or part of a target sequence.

The terms "5'-cap" and "7-methylguanylate (m7G) cap" are used interchangeably herein. A 7-methylguanylate residue is located on the 5' terminus of messenger RNA (mRNA) in eukaryotes. RNA polymerase II (Pol II) transcribes mRNA in eukaryotes. Messenger RNA capping occurs generally as follows: The most terminal 5' phosphate group of the mRNA transcript is removed by RNA terminal phosphatase, leaving two terminal phosphates. A guanosine monophosphate (GMP) is added to the terminal phosphate of the transcript by a guanylyl transferase, leaving a 5'-5' triphosphate-linked guanine at the transcript terminus. Finally, the 7-nitrogen of this terminal guanine is methylated by a methyl transferase.

The terminology "not having a 5'-cap" herein is used to refer to RNA having, for example, a 5'-hydroxyl group instead of a 5'-cap. Such RNA can be referred to as "uncapped RNA", for example. Uncapped RNA can better accumulate in the nucleus following transcription, since 5'-capped RNA is subject to nuclear export. One or more RNA components herein are uncapped.

As used herein, the term "guide polynucleotide", relates to a polynucleotide sequence that can form a complex with a Cas endonuclease, including the Cas endonuclease described herein, and enables the Cas endonuclease to recognize, optionally bind to, and optionally cleave a DNA target site. The guide polynucleotide sequence can be a RNA sequence, a DNA sequence, or a combination thereof (a RNA-DNA combination sequence).

The terms "functional fragment", "fragment that is functionally equivalent" and "functionally equivalent fragment" of a guide RNA, crRNA or tracrRNA are used interchangeably herein, and refer to a portion or subsequence of the guide RNA, crRNA or tracrRNA, respectively, of the present disclosure in which the ability to function as a guide RNA, crRNA or tracrRNA, respectively, is retained.

The terms "functional variant", "variant that is functionally equivalent" and "functionally equivalent variant" of a guide RNA, crRNA or tracrRNA (respectively) are used interchangeably herein, and refer to a variant of the guide RNA, crRNA or tracrRNA, respectively, of the present disclosure in which the ability to function as a guide RNA, crRNA or tracrRNA, respectively, is retained.

The terms "single guide RNA" and "sgRNA" are used interchangeably herein and relate to a synthetic fusion of two RNA molecules, a crRNA (CRISPR RNA) comprising a variable targeting domain (linked to a tracr mate sequence that hybridizes to a tracrRNA), fused to a tracrRNA (trans-activating CRISPR RNA). The single guide RNA can comprise a crRNA or crRNA fragment and a tracrRNA or tracrRNA fragment of the type II CRISPR/Cas system that can form a complex with a type II Cas endonuclease, wherein said guide RNA/Cas endonuclease complex can direct the Cas endonuclease to a DNA target site, enabling the Cas endonuclease to recognize, optionally bind to, and optionally nick or cleave (introduce a single or double-strand break) the DNA target site.

The term "variable targeting domain" or "VT domain" is used interchangeably herein and includes a nucleotide sequence that can hybridize (is complementary) to one strand (nucleotide sequence) of a double strand DNA target site. The percent complementation between the first nucleotide sequence domain (VT domain) and the target sequence can be at least 50%, 51%, 52%, 53%, 54%, 55%, 56%, 57%, 58%, 59%, 60%, 61%, 62%, 63%, 63%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100%. The variable targeting domain can be at least 12, 13, 14, 15, 16, 17, 18, 19, 20, 21, 22, 23, 24, 25, 26, 27, 28, 29 or 30 nucleotides in length. In some embodiments, the variable targeting domain comprises a contiguous stretch of 12 to 30 nucleotides. The variable targeting domain can be composed of a DNA sequence, a RNA sequence, a modified DNA sequence, a modified RNA sequence, or any combination thereof.

The term "Cas endonuclease recognition domain" or "CER domain" (of a guide polynucleotide) is used interchangeably herein and includes a nucleotide sequence that interacts with a Cas endonuclease polypeptide. A CER domain comprises a (trans-acting) tracrNucleotide mate sequence followed by a tracrNucleotide sequence. The CER domain can be composed of a DNA sequence, a RNA sequence, a modified DNA sequence, a modified RNA sequence (see for example US20150059010A1, published 26 Feb. 2015), or any combination thereof.

As used herein, the terms "guide polynucleotide/Cas endonuclease complex", "guide polynucleotide/Cas endonuclease system", "guide polynucleotide/Cas complex", "guide polynucleotide/Cas system" and "guided Cas system" "Polynucleotide-guided endonuclease", "PGEN" are used interchangeably herein and refer to at least one guide polynucleotide and at least one Cas endonuclease, that are capable of forming a complex, wherein said guide polynucleotide/Cas endonuclease complex can direct the Cas endonuclease to a DNA target site, enabling the Cas endonuclease to recognize, bind to, and optionally nick or cleave (introduce a single or double-strand break) the DNA target site. A guide polynucleotide/Cas endonuclease complex herein can comprise Cas protein(s) and suitable polynucleotide component(s) of any of the known CRISPR systems (Horvath and Barrangou, 2010, *Science* 327:167-170; Makarova et al. 2015, *Nature Reviews Microbiology* Vol. 13:1-15; Zetsche et al., 2015, Cell 163, 1-13; Shmakov et al., 2015, *Molecular Cell* 60, 1-13).

The terms "guide RNA/Cas endonuclease complex", "guide RNA/Cas endonuclease system", "guide RNA/Cas complex", "guide RNA/Cas system", "gRNA/Cas complex", "gRNA/Cas system", "RNA-guided endonuclease", "RGEN" are used interchangeably herein and refer to at least one RNA component and at least one Cas endonuclease that are capable of forming a complex, wherein said guide RNA/Cas endonuclease complex can direct the Cas endonuclease to a DNA target site, enabling the Cas endonuclease to recognize, bind to, and optionally nick or cleave (introduce a single or double-strand break) the DNA target site.

The terms "target site", "target sequence", "target site sequence, "target DNA", "target locus", "genomic target site", "genomic target sequence", "genomic target locus", "target polynucleotide", and "protospacer", are used interchangeably herein and refer to a polynucleotide sequence such as, but not limited to, a nucleotide sequence on a chromosome, episome, a locus, or any other DNA molecule in the genome (including chromosomal, chloroplastic, mitochondrial DNA, plasmid DNA) of a cell, at which a guide polynucleotide/Cas endonuclease complex can recognize, bind to, and optionally nick or cleave. The target site can be an endogenous site in the genome of a cell, or alternatively, the target site can be heterologous to the cell and thereby not be naturally occurring in the genome of the cell, or the target site can be found in a heterologous genomic location compared to where it occurs in nature. As used herein, terms "endogenous target sequence" and "native target sequence" are used interchangeable herein to refer to a target sequence that is endogenous or native to the genome of a cell and is at the endogenous or native position of that target sequence in the genome of the cell. An "artificial target site" or "artificial target sequence" are used interchangeably herein and refer to a target sequence that has been introduced into the genome of a cell. Such an artificial target sequence can be identical in sequence to an endogenous or native target sequence in the genome of a cell but be located in a different position (i.e., a non-endogenous or non-native position) in the genome of a cell.

A "protospacer adjacent motif" (PAM) herein refers to a short nucleotide sequence adjacent to a target sequence (protospacer) that is recognized (targeted) by a guide polynucleotide/Cas endonuclease system described herein. The Cas endonuclease may not successfully recognize a target DNA sequence if the target DNA sequence is not followed by a PAM sequence. The sequence and length of a PAM herein can differ depending on the Cas protein or Cas protein complex used. The PAM sequence can be of any length but is typically 1, 2, 3, 4, 5, 6, 7, 8, 9, 10, 11, 12, 13, 14, 15, 16, 17, 18, 19 or 20 nucleotides long.

An "altered target site", "altered target sequence", "modified target site", "modified target sequence", and "modification(s)" or "alteration(s)" of a target site (sequence) are used interchangeably herein and refer to a target sequence as disclosed herein that comprises at least one alteration when compared to non-altered target sequence. A "modified nucleotide" or "edited nucleotide" or "altered nucleotide" refers to a nucleotide sequence of interest that comprises at least one alteration when compared to its non-modified nucleotide sequence. Such "modifications" include, for example: (i) replacement or substitution of at least one nucleotide, (ii) a deletion of at least one nucleotide, (iii) an insertion of at least one nucleotide, (iv) a chemical modification of at least one nucleotide (such as, but not limited to, deamination or other atomic or molecular modification) or (v) any combination of (i)-(iv).

Methods for "modifying a target site" and "altering a target site" are used interchangeably herein and refer to methods for producing an altered target site.

As used herein, "donor DNA" is a DNA construct that comprises a polynucleotide of interest to be inserted into the target site of a double-strand break site.

The term "polynucleotide modification template" includes a polynucleotide that comprises at least one nucleotide modification when compared to the nucleotide sequence to be edited. A nucleotide modification can be at least one nucleotide substitution, addition or deletion. Optionally, the polynucleotide modification template can further comprise homologous nucleotide sequences flanking the at least one nucleotide modification, wherein the flanking homologous nucleotide sequences provide sufficient homology at or near the desired nucleotide sequence to be edited.

The term "plant-optimized Cas endonuclease" herein refers to a Cas protein, including a multifunctional Cas protein, encoded by a nucleotide sequence that has been optimized for expression in a plant cell or plant.

A "plant-optimized nucleotide sequence encoding a Cas endonuclease", "plant-optimized construct encoding a Cas endonuclease" and a "plant-optimized polynucleotide encoding a Cas endonuclease" are used interchangeably herein and refer to a nucleotide sequence encoding a Cas protein, or a variant or functional fragment thereof, that has been optimized for expression in a plant cell or plant. A plant comprising a plant-optimized Cas endonuclease includes a plant comprising the nucleotide sequence encoding for the Cas sequence and/or a plant comprising the Cas endonuclease protein. In one aspect, the plant-optimized Cas endonuclease nucleotide sequence is a maize-optimized, rice-optimized, wheat-optimized, soybean-optimized, cotton-optimized, or canola-optimized Cas endonuclease.

The term "plant" generically includes whole plants, plant organs, plant tissues, seeds, plant cells, seeds and progeny of the same. Plant cells include, without limitation, cells from seeds, suspension cultures, embryos, meristematic regions, callus tissue, leaves, roots, shoots, gametophytes, sporophytes, pollen and microspores.

A "plant element" or "plant part" is intended to reference either a whole plant or a plant component, which may comprise differentiated and/or undifferentiated tissues, for example but not limited to plant tissues, parts, and cell types. In one embodiment, a plant element is one of the following: whole plant, seedling, meristematic tissue, ground tissue, vascular tissue, dermal tissue, seed, leaf, root, shoot, stem, flower, fruit, stolon, bulb, tuber, corm, keiki, shoot, bud, tumor tissue, and various forms of cells and culture (e.g., single cells, protoplasts, embryos, callus tissue), plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like, as well as the parts themselves. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides. The term "plant organ" refers to plant tissue or a group of tissues that constitute a morphologically and functionally distinct part of a plant. As used herein, a "plant element" is synonymous to a "portion" or "part" of a plant, and refers to any part of the plant, and can include distinct tissues and/or organs, and may be used interchangeably with the term "tissue" throughout. Similarly, a "plant reproductive element" is intended to generically reference any part of a plant that is able to initiate other plants via either sexual or asexual reproduction of that plant, for example but not limited to: seed, seedling, root, shoot, cutting, scion, graft, stolon, bulb, tuber, corm, keiki, or bud. The plant element may be in plant or in a plant organ, tissue culture, or cell culture.

"Progeny" comprises any subsequent generation of a plant.

The term "monocotyledonous" or "monocot" refers to the subclass of angiosperm plants also known as "monocotyledoneae", whose seeds typically comprise only one embryonic leaf, or cotyledon. The term includes references to whole plants, plant elements, plant organs (e.g., leaves, stems, roots, etc.), seeds, plant cells, and progeny of the same.

The term "dicotyledonous" or "dicot" refers to the subclass of angiosperm plants also knows as "dicotyledoneae", whose seeds typically comprise two embryonic leaves, or cotyledons. The term includes references to whole plants, plant elements, plant organs (e.g., leaves, stems, roots, etc.), seeds, plant cells, and progeny of the same.

As used herein, a "male sterile plant" is a plant that does not produce male gametes that are viable or otherwise capable of fertilization. As used herein, a "female sterile plant" is a plant that does not produce female gametes that are viable or otherwise capable of fertilization. It is recognized that male-sterile and female-sterile plants can be female-fertile and male-fertile, respectively. It is further recognized that a male fertile (but female sterile) plant can produce viable progeny when crossed with a female fertile plant and that a female fertile (but male sterile) plant can produce viable progeny when crossed with a male fertile plant.

The term "non-conventional yeast" herein refers to any yeast that is not a *Saccharomyces* (e.g., *S. cerevisiae*) or *Schizosaccharomyces* yeast species. (see "Non-Conventional Yeasts in Genetics, Biochemistry and Biotechnology: Practical Protocols", K. Wolf, K. D. Breunig, G. Barth, Eds., Springer-Verlag, Berlin, Germany, 2003).

The term "crossed" or "cross" or "crossing" in the context of this disclosure means the fusion of gametes via pollination to produce progeny (i.e., cells, seeds, or plants). The term encompasses both sexual crosses (the pollination of one plant by another) and selfing (self-pollination, i.e., when the pollen and ovule (or microspores and megaspores) are from the same plant or genetically identical plants).

The term "introgression" refers to the transmission of a desired allele of a genetic locus from one genetic background to another. For example, introgression of a desired allele at a specified locus can be transmitted to at least one progeny plant via a sexual cross between two parent plants, where at least one of the parent plants has the desired allele within its genome. Alternatively, for example, transmission of an allele can occur by recombination between two donor genomes, e.g., in a fused protoplast, where at least one of the donor protoplasts has the desired allele in its genome. The desired allele can be, e.g., a transgene, a modified (mutated or edited) native allele, or a selected allele of a marker or QTL.

The term "isoline" is a comparative term, and references organisms that are genetically identical, but differ in treatment. In one example, two genetically identical maize plant embryos may be separated into two different groups, one receiving a treatment (such as the introduction of a CRISPR-Cas effector endonuclease) and one control that does not receive such treatment. Any phenotypic differences between the two groups may thus be attributed solely to the treatment and not to any inherency of the plant's endogenous genetic makeup.

"Introducing" is intended to mean presenting or providing to a target, such as a cell or organism, a polynucleotide or polypeptide or polynucleotide-protein complex, in such a manner that the component(s) gains access to the interior of a cell of the organism or to the cell itself.

A "polynucleotide of interest" includes any nucleotide sequence that

In some aspects, a "polynucleotide of interest" encodes a protein or polypeptide that is "of interest" for a particular purpose, e.g. a selectable marker. In some aspects a trait or polynucleotide "of interest" is one that improves a desirable phenotype of a plant, particularly a crop plant, i.e. a trait of agronomic interest. Polynucleotides of interest: include, but are not limited to, polynucleotides encoding important traits for agronomics, herbicide-resistance, insecticidal resistance, disease resistance, nematode resistance, herbicide resistance, microbial resistance, fungal resistance, viral resistance, fertility or sterility, grain characteristics, commercial products, phenotypic marker, or any other trait of agronomic or commercial importance. A polynucleotide of interest may additionally be utilized in either the sense or anti-sense orientation. Further, more than one polynucleotide of interest may be utilized together, or "stacked", to provide additional benefit. In some aspects, a "polynucleotide of interest" may encode a gene expression regulatory element, for example a promoter, intron, terminator, 5'UTR, 3'UTR, or other noncoding sequence. In some aspects, a "polynucleotide of interest" may comprise a DNA sequences that encodes for an RNA molecule, for example a functional RNA, siRNA, miRNA, or a guide RNA that is capable of interacting with a Cas endonuclease to bind to a target polynucleotide sequence.

A "complex trait locus" includes a genomic locus that has multiple transgenes genetically linked to each other.

The compositions and methods herein may provide for an improved "agronomic trait" or "trait of agronomic importance" or "trait of agronomic interest" to a plant, which may include, but be not limited to, the following: disease resistance, drought tolerance, heat tolerance, cold tolerance, salinity tolerance, metal tolerance, herbicide tolerance, improved water use efficiency, improved nitrogen utilization, improved nitrogen fixation, pest resistance, herbivore resistance, pathogen resistance, yield improvement, health enhancement, vigor improvement, growth improvement, photosynthetic capability improvement, nutrition enhancement, altered protein content, altered oil content, increased biomass, increased shoot length, increased root length, improved root architecture, modulation of a metabolite, modulation of the proteome, increased seed weight, altered seed carbohydrate composition, altered seed oil composition, altered seed protein composition, altered seed nutrient composition, as compared to an isoline plant not comprising a modification derived from the methods or compositions herein.

"Agronomic trait potential" is intended to mean a capability of a plant element for exhibiting a phenotype, preferably an improved agronomic trait, at some point during its life cycle, or conveying said phenotype to another plant element with which it is associated in the same plant.

The terms "decreased," "fewer," "slower" and "increased" "faster" "enhanced" "greater" as used herein refers to a decrease or increase in a characteristic of the modified plant element or resulting plant compared to an unmodified plant element or resulting plant. For example, a decrease in a characteristic may be at least 1%, at least 2%, at least 3%, at least 4%, at least 5%, between 5% and 10%, at least 10%, between 10% and 20%, at least 15%, at least 20%, between 20% and 30%, at least 25%, at least 30%, between 30% and 40%, at least 35%, at least 40%, between 40% and 50%, at least 45%, at least 50%, between 50% and 60%, at least about 60%, between 60% and 70%, between 70% and 80%, at least 75%, at least about 80%, between 80% and 90%, at least about 90%, between 90% and 100%, at least 100%, between 100% and 200%, at least 200%, at least about 300%, at least about 400%) or more lower than the untreated control and an increase may be at least 1%, at least 2%, at least 3%, at least 4%, at least 5%, between 5% and 10%, at least 10%, between 10% and 20%, at least 15%, at least 20%, between 20% and 30%, at least 25%, at least 30%, between 30% and 40%, at least 35%, at least 40%, between 40% and 50%, at least 45%, at least 50%, between 50% and 60%, at least about 60%, between 60% and 70%, between 70% and 80%, at least 75%, at least about 80%, between 80% and 90%, at least about 90%, between 90% and 100%, at least 100%, between 100% and 200%, at least 200%, at least about 300%, at least about 400% or more higher than the untreated control.

As used herein, the term "before", in reference to a sequence position, refers to an occurrence of one sequence upstream, or 5', to another sequence.

The meaning of abbreviations is as follows: "sec" means second(s), "min" means minute(s), "h" means hour(s), "d" means day(s), "μL" means microliter(s), "mL" means milliliter(s), "L" means liter(s), "μM" means micromolar, "mM" means millimolar, "M" means molar, "mmol" means millimole(s), "μmole" or "umole" mean micromole(s), "g" means gram(s), "μg" or "ug" means microgram(s), "ng" means nanogram(s), "U" means unit(s), "bp" means base pair(s) and "kb" means kilobase(s).

Double-Strand-Break (DSB) Inducing Agents

Double-strand breaks induced by "double-strand-break-inducing agents", such as endonucleases that cleave the phosphodiester bond within a polynucleotide chain, can result in the induction of DNA repair mechanisms, including the non-homologous end-joining (NHEJ) pathway, and homologous recombination (HR). Endonucleases include a range of different enzymes, including restriction endonucleases (see e.g. Roberts et al., (2003) Nucleic Acids Res 1:418-20), Roberts et al., (2003) Nucleic Acids Res 31:1805-12, and Belfort et al., (2002) in Mobile DNA II, pp. 761-783, Eds. Craigie et al., (ASM Press, Washington, DC)), meganucleases (see e.g., WO 2009/114321; Gao et al. (2010) Plant Journal 1:176-187), TAL effector nucleases or TALENs (see e.g., US20110145940, Christian, M., T. Cermak, et al. 2010. Targeting DNA double-strand breaks with TAL effector nucleases. Genetics 186(2): 757-61 and Boch et al., (2009), Science 326(5959): 1509-12), zinc finger nucleases (see e.g. Kim, Y. G., J. Cha, et al. (1996). "Hybrid restriction enzymes: zinc finger fusions to FokI cleavage"), and CRISPR-Cas endonucleases (see e.g. WO2007/025097 application published Mar. 1, 2007).

In addition to the double-strand break inducing agents, site-specific base conversions can also be achieved to engineer one or more nucleotide changes to create one or more EMEs described herein into the genome. These include for example, a site-specific base edit mediated by an C•G to T•A or an A•T to G•C base editing deaminase enzymes (Gaudelli et al., Programmable base editing of A•T to G•C in genomic DNA without DNA cleavage." Nature (2017); Nishida et al. "Targeted nucleotide editing using hybrid prokaryotic and vertebrate adaptive immune systems." Science 353 (6305) (2016); Komor et al. "Programmable editing of a target base in genomic DNA without double-stranded DNA cleavage." Nature 533 (7603) (2016):420-4.

Any double-strand-break or -nick or -modification inducing agent may be used for the methods described herein, including for example but not limited to: Cas endonucleases, recombinases, TALENs, zinc finger nucleases, restriction endonucleases, meganucleases, and deaminases.

CRISPR Systems and Cas Endonucleases

Methods and compositions are provided for polynucleotide modification with a CRISPR Associated (Cas) endonuclease. Class I Cas endonucleases comprise multisubunit effector complexes (Types I, III, and IV), while Class 2 systems comprise single protein effectors (Types II, V, and VI) (Makarova et al. 2015, *Nature Reviews Microbiology* Vol. 13:1-15; Zetsche et al., 2015, Cell 163, 1-13; Shmakov et al., 2015, *Molecular Cell* 60, 1-13; Haft et al., 2005, *Computational Biology, PLoS Comput Biol* 1(6): e60; and Koonin et al. 2017, *Curr Opinion Microbiology* 37:67-78). In Class 2 Type II systems, the Cas endonuclease acts in complex with a guide RNA (gRNA) that directs the Cas endonuclease to cleave the DNA target to enable target recognition, binding, and cleavage by the Cas endonuclease. The gRNA comprises a Cas endonuclease recognition (CER) domain that interacts with the Cas endonuclease, and a Variable Targeting (VT) domain that hybridizes to a nucleotide sequence in a target DNA. In some aspects, the gRNA comprises a CRISPR RNA (crRNA) and a trans-activating CRISPR RNA (tracrRNA) to guide the Cas endonuclease to its DNA target. The crRNA comprises a spacer region complementary to one strand of the double strand DNA target and a region that base pairs with the tracrRNA, forming an RNA duplex. In some aspects, the gRNA is a "single guide RNA" (sgRNA) that comprises a synthetic fusion of crRNA and tracrRNA. In many systems, the Cas endonuclease-guide polynucleotide complex recognizes a short nucleotide sequence adjacent to the target sequence (protospacer), called a "protospacer adjacent motif" (PAM).

Examples of a Cas endonuclease include but are not limited to Cas9 and Cpf1. Cas9 (formerly referred to as Cas5, Csn1, or Csx12) is a Class 2 Type II Cas endonuclease (Makarova et al. 2015, *Nature Reviews Microbiology* Vol. 13:1-15). A Cas9-gRNA complex recognizes a 3' PAM sequence (NGG for the *S. pyogenes* Cas9) at the target site, permitting the spacer of the guide RNA to invade the double-stranded DNA target, and, if sufficient homology between the spacer and protospacer exists, generate a double-strand break cleavage. Cas9 endonucleases comprise RuvC and HNH domains that together produce double strand breaks, and separately can produce single strand breaks. For the *S. pyogenes* Cas9 endonuclease, the double-strand break leaves a blunt end. Cpf1 is a Clas 2 Type V Cas endonuclease, and comprises nuclease RuvC domain but lacks an HNH domain (Yamane et al., 2016, Cell 165:949-962). Cpf1 endonucleases create "sticky" overhang ends.

Some uses for Cas9-gRNA systems at a genomic target site include but are not limited to insertions, deletions, substitutions, or modifications of one or more nucleotides at the target site; modifying or replacing nucleotide sequences of interest (such as a regulatory elements); insertion of polynucleotides of interest; gene knock-out; gene-knock in; modification of splicing sites and/or introducing alternate splicing sites; modifications of nucleotide sequences encoding a protein of interest; amino acid and/or protein fusions; and gene silencing by expressing an inverted repeat into a gene of interest.

In some aspects, a "polynucleotide modification template" is provided that comprises at least one nucleotide modification when compared to the nucleotide sequence to be edited. A nucleotide modification can be at least one nucleotide substitution, addition, deletion, or chemical alteration. Optionally, the polynucleotide modification template can further comprise homologous nucleotide sequences flanking the at least one nucleotide modification, wherein the flanking homologous nucleotide sequences provide sufficient homology to the desired nucleotide sequence to be edited.

In some aspects, a polynucleotide of interest is inserted at a target site and provided as part of a "donor DNA" molecule. As used herein, "donor DNA" is a DNA construct that comprises a polynucleotide of interest to be inserted into the target site of a Cas endonuclease. The donor DNA construct further comprises a first and a second region of homology that flank the polynucleotide of interest. The first and second regions of homology of the donor DNA share homology to a first and a second genomic region, respectively, present in or flanking the target site of the cell or organism genome. The donor DNA can be tethered to the guide polynucleotide. Tethered donor DNAs can allow for co-localizing target and donor DNA, useful in genome editing, gene insertion, and targeted genome regulation, and can also be useful in targeting post-mitotic cells where function of endogenous HR machinery is expected to be highly diminished (Mali et al., 2013, *Nature Methods* Vol. 10: 957-963). The amount of homology or sequence identity shared by a target and a donor polynucleotide can vary and includes total lengths and/or regions.

The process for editing a genomic sequence at a Cas9-gRNA double-strand-break site with a modification template generally comprises: providing a host cell with a Cas9-gRNA complex that recognizes a target sequence in the genome of the host cell and is able to induce a single- or double-strand-break in the genomic sequence, and optionally at least one polynucleotide modification template comprising at least one nucleotide alteration when compared to the nucleotide sequence to be edited. The polynucleotide modification template can further comprise nucleotide sequences flanking the at least one nucleotide alteration, in which the flanking sequences are substantially homologous to the chromosomal region flanking the double-strand break. Genome editing using double-strand-break-inducing agents, such as Cas9-gRNA complexes, has been described, for example in US20150082478 published on 19 Mar. 2015, WO2015026886 published on 26 Feb. 2015, WO2016007347 published 14 Jan. 2016, and WO2016025131 published on 18 Feb. 2016.

To facilitate optimal expression and nuclear localization for eukaryotic cells, the gene comprising the Cas endonuclease may be optimized as described in WO2016186953 published 24 Nov. 2016, and then delivered into cells as DNA expression cassettes by methods known in the art. In some aspects, the Cas endonuclease is provided as a polypeptide. In some aspects, the Cas endonuclease is provided as a polynucleotide encoding a polypeptide. In some aspects, the guide RNA is provided as a DNA molecule encoding one or more RNA molecules. In some aspects, the guide RNA is provide as RNA or chemically-modified RNA. In some aspects, the Cas endonuclease protein and guide RNA are provided as a ribonucleoprotein complex (RNP).

Once a double-strand break is induced in the genome, cellular DNA repair mechanisms are activated to repair the break.

Double-Strand-Break Repair and Polynucleotide Modification

A double-strand-break-inducing agent, such a guided Cas endonuclease can recognize, bind to a DNA target sequence and introduce a single strand (nick) or double-strand break. Once a single or double-strand break is induced in the DNA, the cell's DNA repair mechanism is activated to repair the break, for example via nonhomologous end-joining (NHEJ) or Homology-Directed Repair (HDR) processes which can lead to modifications at the target site. The most common repair mechanism to bring the broken ends together is the nonhomologous end-joining (NHEJ) pathway (Bleuyard et al., (2006) *DNA Repair* 5:1-12). The structural integrity of chromosomes is typically preserved by the repair, but deletions, insertions, or other rearrangements (such as chromosomal translocations) are possible (Siebert and Puchta, 2002, *Plant Cell* 14:1121-31; Pacher et al., 2007, *Genetics* 175: 21-9). NHEJ is often error-prone and can introduce small mutations in the target site. In plants, NHEJ is often the major pathway by which DSBs are remediated; therefore, methods and compositions to improve the probability of HDR or HR in plants are desirable.

As described by Podevin (Podevin, N., Davies, H. V., Hartung, F., Nogue, F. and Casacuberta, J. M. (2013) Site-directed nucleases: a paradigm shift in predictable, knowledge-based plant breeding. *Trends Biotechnol.* 31(6), 375-383), Hilscher (Hilscher, J., Burstmayr, H. and Stoger, E. (2016) Targeted modification of plant genomes for precision crop breeding. *Biotechnol. J.* 11, 1-14), and Pacher (Pacher and Puchta (2016), From classical mutagenesis to nuclease-based breeding—directing natural DNA repair for a natural end-product. The Plant Journal 90(4):819-833), three categories of site-directed nuclease mediated genome modification have been defined, according to the European Union (EU) New Techniques Working Group (NTWG; European Commission et al.) classification of ZFN activity and regulatory purposes:

SDN1 covers the application of a SDN without an additional donor DNA or repair template. Thus the reaction outcome clearly depends on the DSB repair pathway of the plant genome. As the predominant DSB repair pathway is NHEJ, small insertions or deletions can occur (SDN1a). In the case of tandemly arranged SDNs, larger deletions can be obtained (SDN1b). Furthermore, inversions (SDN1c) or translocations (SDN1d) can be generated by multiplexed SDN1 approaches (Hilscher et al., 2016).

SDN2 describes the use of a SDN with an additional DNA "polynucleotide modification template" to introduce small mutations in a controlled manner. Here, a template mainly homologous to the target sequence is provided to be the substrate for HR-mediated DSB repair following the induction of one or two adjacent DSBs. This approach allows the introduction of small mutations that could also occur naturally, per se. Taking the size of plant genomes into account, small modifications up to 20 nucleotides can statistically be regarded as GE that resembles naturally occurring genome changes. Therefore, targeted genome modifications using ODM are also regarded comparable to SDN2.

SDN3 describes the use of a SDN with an additional "donor polynucleotide" or "donor DNA" to introduce large stretches of exogenous DNA at a pre-determined locus, adding or replacing genetic information. Mechanistically, this process relies on HR-mediated DSB repair like SDN2, and the discrimination is arbitrary as the size of the sequence inserted can vary significantly.

Both SDN2 and SDN3 are types of homology-directed repair (HDR) of a double-strand break in a polynucleotide, and involve methods of introducing a heterologous polynucleotide as either a template for repair of the double strand break (SDN2), or insertion of a new double-stranded polynucleotide at the double strand break site (SDN3). SDN2 repairs may be detected by the presence of one or a few nucleotide changes (mutations). SDN3 repairs may be detected by the presence of a novel contiguous heterologous polynucleotide.

Modification of a target polynucleotide includes any one or more of the following: insertion of at least one nucleotide, deletion of at least one nucleotide, chemical alteration of at least one nucleotide, replacement of at least one nucleotide, or mutation of at least one nucleotide. In some aspects, the DNA repair mechanism creates an imperfect repair of the double-strand break, resulting in a change of a nucleotide at the break site. In some aspects, a polynucleotide template may be provided to the break site, wherein the repair results in a template-directed repair of the break. In some aspects, a donor polynucleotide may be provided to the break site, wherein the repair results in the incorporation of the donor polynucleotide into the break site.

In some aspects, the methods and compositions described herein improve the probability of a non-NHEJ repair mechanism outcome at a DSB. In one aspect, an increase of the HDR to NHEJ repair ratio is effected. In some aspects, HDR is achieved via an SDN2 mechanism with a polynucleotide modification template that results in at least one nucleotide modification at the target site. in some aspects, HDR is achieved via an SDN3 mechanism with a donor polynucleotide inserted at the target site.

Homology-Directed Repair and Homologous Recombination

Homology-directed repair (HDR) is a mechanism in cells to repair double-stranded and single stranded DNA breaks. Homology-directed repair includes homologous recombination (HR) and single-strand annealing (SSA) (Lieber. 2010 *Annu. Rev. Biochem.* 79:181-211). The most common form of HDR is called homologous recombination (HR), which has the longest sequence homology requirements between the donor and acceptor DNA. Other forms of HDR include single-stranded annealing (SSA) and breakage-induced replication, and these require shorter sequence homology relative to HR. Homology-directed repair at nicks (single-stranded breaks) can occur via a mechanism distinct from HDR at double-strand breaks (Davis and Maizels. *PNAS* (0027-8424), 111 (10), p. E924-E932). HDR may also be accomplished using regions of microhomology.

By "homology" is meant DNA sequences that are similar. For example, a "region of homology to a genomic region" that is found on the donor DNA is a region of DNA that has a similar sequence to a given "genomic region" in the cell or organism genome. A region of homology can be of any length that is sufficient to promote homologous recombination at the cleaved target site. For example, the region of homology can comprise at least 5-10, 5-15, 5-20, 5-25, 5-30, 5-35, 5-40, 5-45, 5-50, 5-55, 5-60, 5-65, 5-70, 5-75, 5-80, 5-85, 5-90, 5-95, 5-100, 5-200, 5-300, 5-400, 5-500, 5-600, 5-700, 5-800, 5-900, 5-1000, 5-1100, 5-1200, 5-1300, 5-1400, 5-1500, 5-1600, 5-1700, 5-1800, 5-1900, 5-2000, 5-2100, 5-2200, 5-2300, 5-2400, 5-2500, 5-2600, 5-2700, 5-2800, 5-2900, 5-3000, 5-3100 or more bases in length such that the region of homology has sufficient homology to undergo homologous recombination with the corresponding genomic region. "Sufficient homology" indicates that two polynucleotide sequences share structural similarity to act as substrates for a homologous recombination reaction. The structural similarity includes overall length of each polynucleotide fragment, as well as the sequence similarity of the polynucleotides. Sequence similarity can be described by the percent sequence identity over the whole length of the sequences, and/or by conserved regions comprising localized similarities such as contiguous nucleotides having 100% sequence identity, and percent sequence identity over a portion of the length of the sequences.

The amount of homology or sequence identity shared by a target and a donor polynucleotide can vary and includes total lengths and/or regions having unit integral values in the ranges of about 1-20 bp, 20-50 bp, 50-100 bp, 75-150 bp, 100-250 bp, 150-300 bp, 200-400 bp, 250-500 bp, 300-600 bp, 350-750 bp, 400-800 bp, 450-900 bp, 500-1000 bp, 600-1250 bp, 700-1500 bp, 800-1750 bp, 900-2000 bp, 1-2.5 kb, 1.5-3 kb, 2-4 kb, 2.5-5 kb, 3-6 kb, 3.5-7 kb, 4-8 kb, 5-10 kb, or up to and including the total length of the target site. These ranges include every integer within the range, for example, the range of 1-20 bp includes 1, 2, 3, 4, 5, 6, 7, 8, 9, 10, 11, 12, 13, 14, 15, 16, 17, 18, 19 and 20 bps. The amount of homology can also be described by percent sequence identity over the full aligned length of the two polynucleotides which includes percent sequence identity of about at least 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100%. Sufficient homology includes any combination of polynucleotide length, global percent sequence identity, and optionally conserved regions of contiguous nucleotides or local percent sequence identity, for example sufficient homology can be described as a region of 10-100 bp having at least 80% sequence identity to a region of the target locus. Sufficient homology can also be described by the predicted ability of two polynucleotides to specifically hybridize under high stringency conditions, see, for example, Sambrook et al., (1989) *Molecular Cloning: A Laboratory Manual*, (Cold Spring Harbor Laboratory Press, NY); *Current Protocols in Molecular Biology*, Ausubel et al., Eds (1994) Current Protocols, (Greene Publishing Associates, Inc. and John Wiley & Sons, Inc.); and, Tijssen (1993) *Laboratory Techniques in Biochemistry and Molecular Biology—Hybridization with Nucleic Acid Probes*, (Elsevier, New York).

DNA double-strand breaks can be an effective factor to stimulate homologous recombination pathways (Puchta et al., (1995) *Plant Mol Biol* 28:281-92; Tzfira and White, (2005) *Trends Biotechnol* 23:567-9; Puchta, (2005) *J Exp Bot* 56:1-14). Using DNA-breaking agents, a two- to nine-fold increase of homologous recombination was observed between artificially constructed homologous DNA repeats in plants (Puchta et al., (1995) *Plant Mol Biol* 28:281-92). In maize protoplasts, experiments with linear DNA molecules demonstrated enhanced homologous recombination between plasmids (Lyznik et al., (1991) *Mol Gen Genet* 230:209-18).

Alteration of the genome of a prokaryotic and eukaryotic cell or organism cell, for example, through homologous recombination (HR), is a powerful tool for genetic engineering. Homologous recombination has been demonstrated in plants (Halfter et al., (1992) *Mol Gen Genet* 231:186-93) and insects (Dray and Gloor, 1997, *Genetics* 147:689-99). Homologous recombination has also been accomplished in other organisms. For example, at least 150-200 bp of homology was required for homologous recombination in the parasitic protozoan *Leishmania* (Papadopoulou and Dumas, (1997) *Nucleic Acids Res* 25:4278-86). In the filamentous fungus *Aspergillus nidulans*, gene replacement has been accomplished with as little as 50 bp flanking homology (Chaveroche et al., (2000) *Nucleic Acids Res* 28:e97). Targeted gene replacement has also been demonstrated in the ciliate Tetrahymena *thermophila* (Gaertig et al., (1994) *Nucleic Acids Res* 22:5391-8). In mammals, homologous recombination has been most successful in the mouse using pluripotent embryonic stem cell lines (ES) that can be grown in culture, transformed, selected and introduced into a mouse embryo (Watson et al., 1992, Recombinant DNA, 2nd Ed., Scientific American Books distributed by W H Freeman & Co.).

Measuring the Probability of HDR in DSB Repair

Several methods for encouraging the repair of a double strand break via HDR are contemplated, based on the facts that (1) Cas9 has a high affinity for, and is slow to release, its cleaved substrate (Richardson, C. et al. (2016) *Nat. Biotechnol.* 34:339-344); and (2) the observation by the inventors that the mutation outcomes for polynucleotide cleavage are often non-random and reproducible (unpublished). The inventors have conceived that flanking a donor DNA or polynucleotide template with sequences comprising homology to one or more target sites promotes the occurrence of HDR vs NHEJ.

In some aspects, the fraction or percent of HR reads is greater than of a comparator, such as a control sample, sample with NHEJ repair, or as compared to the total mutant reads. In some aspects, the fraction or percent of HR reads is greater than of the control sample (no DSB agent). In some aspects, the fraction or percent of HR reads is greater than the fraction or percent of NHEJ reads. In some aspects, the fraction or percent of HR reads is greater than the fraction or percent of total mutant reads (NHEJ+HR).

In some aspects, the fraction of HR reads relative to a comparator is at least 2, 3, 4, 5, 6, 7, 8, 9, 10, between 10 and 15, 15, between 15 and 20, 20, between 20 and 25, 25, between 25 and 30, 30, between 30 and 40, 40, between 40 and 50, 50, between 50 and 60, 60, between 60 and 70, 70, between 70 and 80, 80, between 80 and 90, 90, between 90 and 100, 100, between 100 and 125, 125, between 125 and 150, greater than 150, or infinitely greater.

In some aspects, the percent of HR reads relative a comparator is at least 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 20%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% greater.

In some aspects, the percent of HR reads is greater than zero.

Gene Targeting

The compositions and methods described herein can be used for gene targeting.

In general, DNA targeting can be performed by cleaving one or both strands at a specific polynucleotide sequence in a cell with a Cas endonuclease associated with a suitable guide polynucleotide component. Once a single or double-strand break is induced in the DNA, the cell's DNA repair mechanism is activated to repair the break via nonhomologous end-joining (NHEJ) or Homology-Directed Repair (HDR) processes which can lead to modifications at the target site.

The length of the DNA sequence at the target site can vary, and includes, for example, target sites that are at least 12, 13, 14, 15, 16, 17, 18, 19, 20, 21, 22, 23, 24, 25, 26, 27, 28, 29, 30, or more than 30 nucleotides in length. It is further possible that the target site can be palindromic, that is, the sequence on one strand reads the same in the opposite direction on the complementary strand. The nick/cleavage site can be within the target sequence or the nick/cleavage site could be outside of the target sequence. In another variation, the cleavage could occur at nucleotide positions immediately opposite each other to produce a blunt end cut or, in other cases, the incisions could be staggered to produce single-stranded overhangs, also called "sticky ends", which can be either 5' overhangs, or 3' overhangs. Active variants of genomic target sites can also be used. Such active variants can comprise at least 65%, 70%, 75%, 80%, 85%, 90%, 91%, 92%, 93%, 94%, 95%, 96%, 97%, 98%, 99% or more sequence identity to the given target site, wherein the active variants retain biological activity and hence are capable of being recognized and cleaved by an Cas endonuclease.

Assays to measure the single or double-strand break of a target site by an endonuclease are known in the art and generally measure the overall activity and specificity of the agent on DNA substrates comprising recognition sites.

A targeting method herein can be performed in such a way that two or more DNA target sites are targeted in the method, for example. Such a method can optionally be characterized as a multiplex method. Two, three, four, five, six, seven, eight, nine, ten, or more target sites can be targeted at the same time in certain embodiments. A multiplex method is typically performed by a targeting method herein in which multiple different RNA components are provided, each designed to guide a guide polynucleotide/Cas endonuclease complex to a unique DNA target site.

Gene Editing

The process for editing a genomic sequence combining DSB and modification templates generally comprises: introducing into a host cell a DSB-inducing agent, or a nucleic acid encoding a DSB-inducing agent, that recognizes a target sequence in the chromosomal sequence and is able to induce a DSB in the genomic sequence, and at least one polynucleotide modification template comprising at least one nucleotide alteration when compared to the nucleotide sequence to be edited. The polynucleotide modification template can further comprise nucleotide sequences flanking the at least one nucleotide alteration, in which the flanking sequences are substantially homologous to the chromosomal region flanking the DSB. Genome editing using DSB-inducing agents, such as Cas-gRNA complexes, has been described, for example in US20150082478 published on 19 Mar. 2015, WO2015026886 published on 26 Feb. 2015, WO2016007347 published 14 Jan. 2016, and WO/2016/025131 published on 18 Feb. 2016.

Some uses for guide RNA/Cas endonuclease systems have been described (see for example: US20150082478 A1 published 19 Mar. 2015, WO2015026886 published 26 Feb. 2015, and US20150059010 published 26 Feb. 2015) and include but are not limited to modifying or replacing nucleotide sequences of interest (such as a regulatory elements), insertion of polynucleotides of interest, gene drop-out, gene knock-out, gene-knock in, modification of splicing sites and/or introducing alternate splicing sites, modifications of nucleotide sequences encoding a protein of interest, amino acid and/or protein fusions, and gene silencing by expressing an inverted repeat into a gene of interest.

Proteins may be altered in various ways including amino acid substitutions, deletions, truncations, and insertions. Methods for such manipulations are generally known. For example, amino acid sequence variants of the protein(s) can be prepared by mutations in the DNA. Methods for mutagenesis and nucleotide sequence alterations include, for example, Kunkel, (1985) *Proc. Natl. Acad. Sci. USA* 82:488-92; Kunkel et al., (1987) *Meth Enzymol* 154:367-82; U.S. Pat. No. 4,873,192; Walker and Gaastra, eds. (1983) *Techniques in Molecular Biology* (MacMillan Publishing Company, New York) and the references cited therein. Guidance regarding amino acid substitutions not likely to affect biological activity of the protein is found, for example, in the model of Dayhoff et al., (1978) *Atlas of Protein Sequence and Structure* (Natl Biomed Res Found, Washington, D.C.). Conservative substitutions, such as exchanging one amino acid with another having similar properties, may be preferable. Conservative deletions, insertions, and amino acid substitutions are not expected to produce radical changes in the characteristics of the protein, and the effect of any substitution, deletion, insertion, or combination thereof can be evaluated by routine screening assays. Assays for double-strand-break-inducing activity are known and generally measure the overall activity and specificity of the agent on DNA substrates comprising target sites.

Described herein are methods for genome editing with Cleavage Ready Cascade (crCascade) Complexes. Following characterization of the guide RNA and PAM sequence, components of the cleavage ready Cascade (crCascade) complex and associated CRISPR RNA (crRNA) may be utilized to modify chromosomal DNA in other organisms including plants. To facilitate optimal expression and nuclear localization (for eukaryotic cells), the genes comprising the crCascade may be optimized as described in WO2016186953 published 24 Nov. 2016, and then delivered into cells as DNA expression cassettes by methods known in the art. The components necessary to comprise an active crCascade complex may also be delivered as RNA with or without modifications that protect the RNA from degradation or as mRNA capped or uncapped (Zhang, Y. et al., 2016, Nat. Commun. 7:12617) or Cas protein guide polynucleotide complexes (WO2017070032 published 27 Apr. 2017), or any combination thereof. Additionally, a part or part(s) of the crCascade complex and crRNA may be expressed from a DNA construct while other components are delivered as RNA with or without modifications that protect the RNA from degradation or as mRNA capped or uncapped (Zhang et al. 2016 *Nat. Commun.* 7:12617) or Cas protein guide polynucleotide complexes (WO2017070032 published 27 Apr. 2017) or any combination thereof. To produce crRNAs in-vivo, tRNA derived elements may also be used to recruit endogenous RNAses to cleave crRNA transcripts into mature forms capable of guiding the crCascade complex to its DNA target site, as described, for example, in WO2017105991 published 22 Jun. 2017. crCascade nickase complexes may be utilized separately or concertedly to generate a single or multiple DNA nicks on one or both DNA strands. Furthermore, the cleavage activity of the Cas endonuclease may be deactivated by altering key catalytic residues in its cleavage domain (Sinkunas, T. et al., 2013, *EMBO J.* 32:385-394) resulting in a RNA guided helicase that may be used to enhance homology-directed repair, induce transcriptional activation, or remodel local DNA structures. Moreover, the activity of the Cas cleavage and helicase domains may both be knocked-out and used in combination with other DNA cutting, DNA nicking, DNA binding, transcriptional activation, transcriptional repression, DNA remodeling, DNA deamination, DNA unwinding, DNA recombination enhancing, DNA integration, DNA inversion, and DNA repair agents.

The transcriptional direction of the tracrRNA for the CRISPR-Cas system (if present) and other components of the CRISPR-Cas system (such as variable targeting domain, crRNA repeat, loop, anti-repeat) can be deduced as described in WO2016186946 published 24 Nov. 2016, and WO2016186953 published 24 Nov. 2016.

As described herein, once the appropriate guide RNA requirement is established, the PAM preferences for each new system disclosed herein may be examined. If the cleavage ready Cascade (crCascade) complex results in degradation of the randomized PAM library, the crCascade complex can be converted into a nickase by disabling the ATPase dependent helicase activity either through mutagenesis of critical residues or by assembling the reaction in the absence of ATP as described previously (Sinkunas, T. et al., 2013, EMBO J. 32:385-394). Two regions of PAM randomization separated by two protospacer targets may be utilized to generate a double-stranded DNA break which may be captured and sequenced to examine the PAM sequences that support cleavage by the respective crCascade complex.

In one embodiment, the invention describes a method for modifying a target site in the genome of a cell, the method comprising introducing into a cell at least one Cas endonuclease and guide RNA, and identifying at least one cell that has a modification at the target site.

The nucleotide to be edited can be located within or outside a target site recognized and cleaved by a Cas endonuclease. In one embodiment, the at least one nucleotide modification is not a modification at a target site recognized and cleaved by a Cas endonuclease. In another embodiment, there are at least 1, 2, 3, 4, 5, 6, 7, 8, 9, 10, 11, 12, 13, 14, 15, 16, 17, 18, 19, 20, 21, 22, 23, 24, 25, 26, 27, 30, 40, 50, 100, 200, 300, 400, 500, 600, 700, 900 or 1000 nucleotides between the at least one nucleotide to be edited and the genomic target site.

A knock-out may be produced by an indel (insertion or deletion of nucleotide bases in a target DNA sequence through NHEJ), or by specific removal of sequence that reduces or completely destroys the function of sequence at or near the targeting site.

A guide polynucleotide/Cas endonuclease induced targeted mutation can occur in a nucleotide sequence that is located within or outside a genomic target site that is recognized and cleaved by the Cas endonuclease.

The method for editing a nucleotide sequence in the genome of a cell can be a method without the use of an exogenous selectable marker by restoring function to a non-functional gene product.

In one embodiment, the invention describes a method for modifying a target site in the genome of a cell, the method comprising introducing into a cell at least one PGEN described herein and at least one donor DNA, wherein said donor DNA comprises a polynucleotide of interest, and optionally, further comprising identifying at least one cell that said polynucleotide of interest integrated in or near said target site.

In one aspect, the methods disclosed herein may employ homologous recombination (HR) to provide integration of the polynucleotide of interest at the target site.

Various methods and compositions can be employed to produce a cell or organism having a polynucleotide of interest inserted in a target site via activity of a CRISPR-Cas system component described herein. In one method described herein, a polynucleotide of interest is introduced into the organism cell via a donor DNA construct. As used herein, "donor DNA" is a DNA construct that comprises a polynucleotide of interest to be inserted into the target site of a Cas endonuclease. The donor DNA construct further comprises a first and a second region of homology that flank the polynucleotide of interest. The first and second regions of homology of the donor DNA share homology to a first and a second genomic region, respectively, present in or flanking the target site of the cell or organism genome.

The donor DNA can be tethered to the guide polynucleotide. Tethered donor DNAs can allow for co-localizing target and donor DNA, useful in genome editing, gene insertion, and targeted genome regulation, and can also be useful in targeting post-mitotic cells where function of endogenous HR machinery is expected to be highly diminished (Mali et al., 2013, *Nature Methods* Vol. 10: 957-963).

The amount of homology or sequence identity shared by a target and a donor polynucleotide can vary and includes total lengths and/or regions having unit integral values in the ranges of about 1-20 bp, 20-50 bp, 50-100 bp, 75-150 bp, 100-250 bp, 150-300 bp, 200-400 bp, 250-500 bp, 300-600 bp, 350-750 bp, 400-800 bp, 450-900 bp, 500-1000 bp, 600-1250 bp, 700-1500 bp, 800-1750 bp, 900-2000 bp, 1-2.5 kb, 1.5-3 kb, 2-4 kb, 2.5-5 kb, 3-6 kb, 3.5-7 kb, 4-8 kb, 5-10 kb, or up to and including the total length of the target site. These ranges include every integer within the range, for example, the range of 1-20 bp includes 1, 2, 3, 4, 5, 6, 7, 8, 9, 10, 11, 12, 13, 14, 15, 16, 17, 18, 19 and 20 bps. The amount of homology can also be described by percent sequence identity over the full aligned length of the two polynucleotides which includes percent sequence identity of about at least 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100%. Sufficient homology includes any combination of polynucleotide length, global percent sequence identity, and optionally conserved regions of contiguous nucleotides or local percent sequence identity, for example sufficient homology can be described as a region of 75-150 bp having at least 80% sequence identity to a region of the target locus. Sufficient homology can also be described by the predicted ability of two polynucleotides to specifically hybridize under high stringency conditions, see, for example, Sambrook et al., (1989) *Molecular Cloning: A Laboratory Manual*, (Cold Spring Harbor Laboratory Press, NY); *Current Protocols in Molecular Biology*, Ausubel et al., Eds (1994) Current Protocols, (Greene Publishing Associates, Inc. and John Wiley & Sons, Inc.); and, Tijssen (1993) *Laboratory Techniques in Biochemistry and Molecular Biology-Hybridization with Nucleic Acid Probes*, (Elsevier, New York).

Episomal DNA molecules can also be ligated into the double-strand break, for example, integration of T-DNAs into chromosomal double-strand breaks (Chilton and Que, (2003) *Plant Physiol* 133:956-65; Salomon and Puchta, (1998) *EMBO J.* 17:6086-95). Once the sequence around the double-strand breaks is altered, for example, by exonuclease activities involved in the maturation of double-strand breaks, gene conversion pathways can restore the original structure if a homologous sequence is available, such as a homologous chromosome in non-dividing somatic cells, or a sister chromatid after DNA replication (Molinier et al., (2004) *Plant Cell* 16:342-52). Ectopic and/or epigenic DNA sequences may also serve as a DNA repair template for homologous recombination (Puchta, (1999) *Genetics* 152: 1173-81).

In one embodiment, the disclosure comprises a method for editing a nucleotide sequence in the genome of a cell, the method comprising introducing into at least one PGEN described herein, and a polynucleotide modification template, wherein said polynucleotide modification template comprises at least one nucleotide modification of said nucleotide sequence, and optionally further comprising selecting at least one cell that comprises the edited nucleotide sequence.

The guide polynucleotide/Cas endonuclease system can be used in combination with at least one polynucleotide modification template to allow for editing (modification) of a genomic nucleotide sequence of interest. (See also US20150082478, published 19 Mar. 2015 and WO2015026886 published 26 Feb. 2015).

Polynucleotides of interest and/or traits can be stacked together in a complex trait locus as described in WO2012129373 published 27 Sep. 2012, and in WO2013112686, published 1 Aug. 2013. The guide polynucleotide/Cas9 endonuclease system described herein provides for an efficient system to generate double-strand breaks and allows for traits to be stacked in a complex trait locus.

A guide polynucleotide/Cas system as described herein, mediating gene targeting, can be used in methods for directing heterologous gene insertion and/or for producing complex trait loci comprising multiple heterologous genes in a fashion similar as disclosed in WO2012129373 published 27 Sep. 2012, where instead of using a double-strand break inducing agent to introduce a gene of interest, a guide polynucleotide/Cas system as disclosed herein is used. By inserting independent transgenes within 0.1, 0.2, 0.3, 0.4, 0.5, 1.0, 2, or even 5 centimorgans (cM) from each other, the transgenes can be bred as a single genetic locus (see, for example, US20130263324 published 3 Oct. 2013 or WO2012129373 published 14 Mar. 2013). After selecting a plant comprising a transgene, plants comprising (at least) one transgenes can be crossed to form an F1 that comprises both transgenes. In progeny from these F1 (F2 or BC1) 1/500 progeny would have the two different transgenes recombined onto the same chromosome. The complex locus can then be bred as single genetic locus with both transgene traits. This process can be repeated to stack as many traits as desired.

Further uses for guide RNA/Cas endonuclease systems have been described (See for example: US20150082478 published 19 Mar. 2015, WO2015026886 published 26 Feb. 2015, US20150059010 published 26 Feb. 2015, WO2016007347 published 14 Jan. 2016, and PCT application WO2016025131 published 18 Feb. 2016) and include but are not limited to modifying or replacing nucleotide sequences of interest (such as a regulatory elements), insertion of polynucleotides of interest, gene knock-out, gene-knock in, modification of splicing sites and/or introducing alternate splicing sites, modifications of nucleotide sequences encoding a protein of interest, amino acid and/or protein fusions, and gene silencing by expressing an inverted repeat into a gene of interest.

Resulting characteristics from the gene editing compositions and methods described herein may be evaluated. Chromosomal intervals that correlate with a phenotype or trait of interest can be identified. A variety of methods well known in the art are available for identifying chromosomal intervals. The boundaries of such chromosomal intervals are drawn to encompass markers that will be linked to the gene controlling the trait of interest. In other words, the chromosomal interval is drawn such that any marker that lies within that interval (including the terminal markers that define the boundaries of the interval) can be used as a marker for a particular trait. In one embodiment, the chromosomal interval comprises at least one QTL, and furthermore, may indeed comprise more than one QTL. Close proximity of multiple QTLs in the same interval may obfuscate the correlation of a particular marker with a particular QTL, as one marker may demonstrate linkage to more than one QTL. Conversely, e.g., if two markers in close proximity show co-segregation with the desired phenotypic trait, it is sometimes unclear if each of those markers identifies the same QTL or two different QTL. The term "quantitative trait locus" or "QTL" refers to a region of DNA that is associated with the differential expression of a quantitative phenotypic trait in at least one genetic background, e.g., in at least one breeding population. The region of the QTL encompasses or is closely linked to the gene or genes that affect the trait in question. An "allele of a QTL" can comprise multiple genes or other genetic factors within a contiguous genomic region or linkage group, such as a haplotype. An allele of a QTL can denote a haplotype within a specified window wherein said window is a contiguous genomic region that can be defined, and tracked, with a set of one or more polymorphic markers. A haplotype can be defined by the unique fingerprint of alleles at each marker within the specified window.

Recombinant Constructs and Transformation of Cells

The disclosed guide polynucleotides, Cas endonucleases, polynucleotide modification templates, donor DNAs, guide polynucleotide/Cas endonuclease systems disclosed herein, and any one combination thereof, optionally further comprising one or more polynucleotide(s) of interest, can be introduced into a cell. Cells include, but are not limited to, human, non-human, animal, bacterial, fungal, insect, yeast, non-conventional yeast, and plant cells as well as plants and seeds produced by the methods described herein.

Standard recombinant DNA and molecular cloning techniques used herein are well known in the art and are described more fully in Sambrook et al., *Molecular Cloning: A Laboratory Manual; Cold Spring Harbor Laboratory*: Cold Spring Harbor, NY (1989). Transformation methods are well known to those skilled in the art and are described infra.

Vectors and constructs include circular plasmids, and linear polynucleotides, comprising a polynucleotide of interest and optionally other components including linkers, adapters, regulatory or analysis. In some examples a recognition site and/or target site can be comprised within an intron, coding sequence, 5' UTRs, 3' UTRs, and/or regulatory regions.

Components for Expression and Utilization of CRISPR-Cas Systems in Prokaryotic and Eukaryotic Cells The invention further provides expression constructs for expressing in a prokaryotic or eukaryotic cell/organism a guide RNA/Cas system that is capable of recognizing, binding to, and optionally nicking, unwinding, or cleaving all or part of a target sequence.

In one embodiment, the expression constructs of the disclosure comprise a promoter operably linked to a nucleotide sequence encoding a Cas gene (or plant optimized, including a Cas endonuclease gene described herein) and a promoter operably linked to a guide RNA of the present disclosure. The promoter is capable of driving expression of an operably linked nucleotide sequence in a prokaryotic or eukaryotic cell/organism.

Nucleotide sequence modification of the guide polynucleotide, VT domain and/or CER domain can be selected from, but not limited to, the group consisting of a 5' cap, a 3' polyadenylated tail, a riboswitch sequence, a stability control sequence, a sequence that forms a dsRNA duplex, a modification or sequence that targets the guide poly nucleotide to a subcellular location, a modification or sequence that provides for tracking, a modification or sequence that provides a binding site for proteins, a Locked Nucleic Acid (LNA), a 5-methyl dC nucleotide, a 2,6-Diaminopurine nucleotide, a 2'-Fluoro A nucleotide, a 2'-Fluoro U nucleotide; a 2'-O-Methyl RNA nucleotide, a phosphorothioate bond, linkage to a cholesterol molecule, linkage to a polyethylene glycol molecule, linkage to a spacer 18 molecule, a 5' to 3' covalent linkage, or any combination thereof. These modifications can result in at least one additional beneficial feature, wherein the additional beneficial feature is selected from the group of a modified or regulated stability, a subcellular targeting, tracking, a fluorescent label, a binding site for a protein or protein complex, modified binding affinity to complementary target sequence, modified resistance to cellular degradation, and increased cellular permeability.

A method of expressing RNA components such as gRNA in eukaryotic cells for performing Cas9-mediated DNA targeting has been to use RNA polymerase III (Pol III) promoters, which allow for transcription of RNA with precisely defined, unmodified, 5'- and 3'-ends (DiCarlo et al., *Nucleic Acids Res.* 41: 4336-4343; Ma et al., *Mol. Ther. Nucleic Acids* 3:e161). This strategy has been successfully applied in cells of several different species including maize and soybean (US20150082478 published 19 Mar. 2015). Methods for expressing RNA components that do not have a 5' cap have been described (WO2016/025131 published 18 Feb. 2016).

Various methods and compositions can be employed to obtain a cell or organism having a polynucleotide of interest inserted in a target site for a Cas endonuclease. Such methods can employ homologous recombination (HR) to provide integration of the polynucleotide of interest at the target site. In one method described herein, a polynucleotide of interest is introduced into the organism cell via a donor DNA construct.

The donor DNA construct further comprises a first and a second region of homology that flank the polynucleotide of interest. The first and second regions of homology of the donor DNA share homology to a first and a second genomic region, respectively, present in or flanking the target site of the cell or organism genome.

The donor DNA can be tethered to the guide polynucleotide. Tethered donor DNAs can allow for co-localizing target and donor DNA, useful in genome editing, gene insertion, and targeted genome regulation, and can also be useful in targeting post-mitotic cells where function of endogenous HR machinery is expected to be highly diminished (*Mali* et al., 2013, *Nature Methods* Vol. 10: 957-963).

The amount of homology or sequence identity shared by a target and a donor polynucleotide can vary and includes total lengths and/or regions having unit integral values in the ranges of about 1-20 bp, 20-50 bp, 50-100 bp, 75-150 bp, 100-250 bp, 150-300 bp, 200-400 bp, 250-500 bp, 300-600 bp, 350-750 bp, 400-800 bp, 450-900 bp, 500-1000 bp, 600-1250 bp, 700-1500 bp, 800-1750 bp, 900-2000 bp, 1-2.5 kb, 1.5-3 kb, 2-4 kb, 2.5-5 kb, 3-6 kb, 3.5-7 kb, 4-8 kb, 5-10 kb, or up to and including the total length of the target site. These ranges include every integer within the range, for example, the range of 1-20 bp includes 1, 2, 3, 4, 5, 6, 7, 8, 9, 10, 11, 12, 13, 14, 15, 16, 17, 18, 19 and 20 bps. The amount of homology can also be described by percent sequence identity over the full aligned length of the two polynucleotides which includes percent sequence identity at least of about 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, between 98% and 99%, 99%, between 99% and 100%, or 100%. Sufficient homology includes any combination of polynucleotide length, global percent sequence identity, and optionally conserved regions of contiguous nucleotides or local percent sequence identity, for example sufficient homology can be described as a region of 75-150 bp having at least 80% sequence identity to a region of the target locus. Sufficient homology can also be described by the predicted ability of two polynucleotides to specifically hybridize under high stringency conditions, see, for example, Sambrook et al., (1989) *Molecular Cloning: A Laboratory Manual*, (Cold Spring Harbor Laboratory Press, NY); *Current Protocols in Molecular Biology*, Ausubel et al., Eds (1994) *Current Protocols*, (Greene Publishing Associates, Inc. and John Wiley & Sons, Inc.); and, Tijssen (1993) *Laboratory Techniques in Biochemistry and Molecular Biology—Hybridization with Nucleic Acid Probes*, (Elsevier, New York).

The structural similarity between a given genomic region and the corresponding region of homology found on the donor DNA can be any degree of sequence identity that allows for homologous recombination to occur. For example, the amount of homology or sequence identity shared by the "region of homology" of the donor DNA and the "genomic region" of the organism genome can be at least 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity, such that the sequences undergo homologous recombination The region of homology on the donor DNA can have homology to any sequence flanking the target site. While in some instances the regions of homology share significant sequence homology to the genomic sequence immediately flanking the target site, it is recognized that the regions of homology can be designed to have sufficient homology to regions that may be further 5' or 3' to the target site. The regions of homology can also have homology with a fragment of the target site along with downstream genomic regions In one embodiment, the first region of homology further comprises a first fragment of the target site and the second region of homology comprises a second fragment of the target site, wherein the first and second fragments are dissimilar.

Polynucleotides of Interest

Polynucleotides of interest are further described herein and include polynucleotides reflective of the commercial markets and interests of those involved in the development of the crop. Crops and markets of interest change, and as developing nations open up world markets, new crops and technologies will emerge also. In addition, as our understanding of agronomic traits and characteristics such as yield and heterosis increase, the choice of genes for genetic engineering will change accordingly.

General categories of polynucleotides of interest include, for example, genes of interest involved in information, such as zinc fingers, those involved in communication, such as kinases, and those involved in housekeeping, such as heat shock proteins. More specific polynucleotides of interest include, but are not limited to, genes involved in traits of agronomic interest such as but not limited to: crop yield, grain quality, crop nutrient content, starch and carbohydrate quality and quantity as well as those affecting kernel size, sucrose loading, protein quality and quantity, nitrogen fixation and/or utilization, fatty acid and oil composition, genes encoding proteins conferring resistance to abiotic stress (such as drought, nitrogen, temperature, salinity, toxic metals or trace elements, or those conferring resistance to toxins such as pesticides and herbicides), genes encoding proteins conferring resistance to biotic stress (such as attacks by fungi, viruses, bacteria, insects, and nematodes, and development of diseases associated with these organisms).

Agronomically important traits such as oil, starch, and protein content can be genetically altered in addition to using traditional breeding methods. Modifications include increasing content of oleic acid, saturated and unsaturated oils, increasing levels of lysine and sulfur, providing essential amino acids, and also modification of starch. Hordothionin protein modifications are described in U.S. Pat. Nos. 5,703,049, 5,885,801, 5,885,802, and 5,990,389.

Polynucleotide sequences of interest may encode proteins involved in providing disease or pest resistance. By "disease resistance" or "pest resistance" is intended that the plants avoid the harmful symptoms that are the outcome of the plant-pathogen interactions. Pest resistance genes may encode resistance to pests that have great yield drag such as rootworm, cutworm, European Corn Borer, and the like. Disease resistance and insect resistance genes such as lysozymes or cecropins for antibacterial protection, or proteins such as defensins, glucanases or chitinases for antifungal protection, or Bacillus thuringiensis endotoxins, protease inhibitors, collagenases, lectins, or glycosidases for controlling nematodes or insects are all examples of useful gene products. Genes encoding disease resistance traits include detoxification genes, such as against fumonisin (U.S. Pat. No. 5,792,931); avirulence (avr) and disease resistance (R) genes (Jones et al. (1994) Science 266:789; Martin et al. (1993) Science 262:1432; and Mindrinos et al. (1994) Cell 78:1089); and the like. Insect resistance genes may encode resistance to pests that have great yield drag such as rootworm, cutworm, European Corn Borer, and the like. Such genes include, for example, Bacillus thuringiensis toxic protein genes (U.S. Pat. Nos. 5,366,892; 5,747,450; 5,736,514; 5,723,756; 5,593,881; and Geiser et al. (1986) Gene 48:109); and the like.

An "herbicide resistance protein" or a protein resulting from expression of an "herbicide resistance-encoding nucleic acid molecule" includes proteins that confer upon a cell the ability to tolerate a higher concentration of an herbicide than cells that do not express the protein, or to tolerate a certain concentration of an herbicide for a longer period of time than cells that do not express the protein. Herbicide resistance traits may be introduced into plants by genes coding for resistance to herbicides that act to inhibit the action of acetolactate synthase (ALS, also referred to as acetohydroxyacid synthase, AHAS), in particular the sulfonylurea (UK: sulphonylurea) type herbicides, genes coding for resistance to herbicides that act to inhibit the action of glutamine synthase, such as phosphinothricin or basta (e.g., the bar gene), glyphosate (e.g., the EPSP synthase gene and the GAT gene), HPPD inhibitors (e.g, the HPPD gene) or other such genes known in the art. See, for example, U.S. Pat. Nos. 7,626,077, 5,310,667, 5,866,775, 6,225,114, 6,248,876, 7,169,970, 6,867,293, and 9,187,762. The bar gene encodes resistance to the herbicide basta, the nptII gene encodes resistance to the antibiotics kanamycin and geneticin, and the ALS-gene mutants encode resistance to the herbicide chlorsulfuron.

Furthermore, it is recognized that the polynucleotide of interest may also comprise antisense sequences complementary to at least a portion of the messenger RNA (mRNA) for a targeted gene sequence of interest. Antisense nucleotides are constructed to hybridize with the corresponding mRNA. Modifications of the antisense sequences may be made as long as the sequences hybridize to and interfere with expression of the corresponding mRNA. In this manner, antisense constructions having 70%, 80%, or 85% sequence identity to the corresponding antisense sequences may be used. Furthermore, portions of the antisense nucleotides may be used to disrupt the expression of the target gene. Generally, sequences of at least 50 nucleotides, 100 nucleotides, 200 nucleotides, or greater may be used.

In addition, the polynucleotide of interest may also be used in the sense orientation to suppress the expression of endogenous genes in plants. Methods for suppressing gene expression in plants using polynucleotides in the sense orientation are known in the art. The methods generally involve transforming plants with a DNA construct comprising a promoter that drives expression in a plant operably linked to at least a portion of a nucleotide sequence that corresponds to the transcript of the endogenous gene. Typically, such a nucleotide sequence has substantial sequence identity to the sequence of the transcript of the endogenous gene, generally greater than about 65% sequence identity, about 85% sequence identity, or greater than about 95% sequence identity. See U.S. Pat. Nos. 5,283,184 and 5,034,323.

The polynucleotide of interest can also be an expression regulatory element, such as but not limited to a promoter, enhancer, intron, terminator, or UTR (untranslated regulatory sequence). A UTR may be present at either the 5' end or the 3' end of a coding or noncoding sequence. Other examples of polynucleotides of interest include genes encoding for ribonucleotide molecules, for example mRNA, siRNA, or other ribonucleotides. The regulatory element or RNA molecule may be endogenous to the cell in which the genetic modification occurs, or it may be heterologous to the cell.

The polynucleotide of interest can also be a phenotypic marker. A phenotypic marker is screenable or a selectable marker that includes visual markers and selectable markers whether it is a positive or negative selectable marker. Any phenotypic marker can be used. Specifically, a selectable or screenable marker comprises a DNA segment that allows one to identify, or select for or against a molecule or a cell that comprises it, often under particular conditions. These markers can encode an activity, such as, but not limited to, production of RNA, peptide, or protein, or can provide a binding site for RNA, peptides, proteins, inorganic and organic compounds or compositions and the like.

Examples of selectable markers include, but are not limited to, DNA segments that comprise restriction enzyme sites; DNA segments that encode products which provide resistance against otherwise toxic compounds including antibiotics, such as, spectinomycin, ampicillin, kanamycin, tetracycline, Basta, neomycin phosphotransferase II (NEO) and hygromycin phosphotransferase (HPT)); DNA segments that encode products which are otherwise lacking in the recipient cell (e.g., tRNA genes, auxotrophic markers); DNA segments that encode products which can be readily identified (e.g., phenotypic markers such as 0-galactosidase, GUS; fluorescent proteins such as green fluorescent protein (GFP), cyan (CFP), yellow (YFP), red (RFP), and cell surface proteins); the generation of new primer sites for PCR (e.g., the juxtaposition of two DNA sequence not previously juxtaposed), the inclusion of DNA sequences not acted upon or acted upon by a restriction endonuclease or other DNA modifying enzyme, chemical, etc.; and, the inclusion of a DNA sequences required for a specific modification (e.g., methylation) that allows its identification.

Additional selectable markers include genes that confer resistance to herbicidal compounds, such as sulphonylureas, glufosinate ammonium, bromoxynil, imidazolinones, and 2,4-dichlorophenoxyacetate (2,4-D). See for example, Acetolactase synthase (ALS) for resistance to sulfonylureas, imidazolinones, triazolopyrimidine sulfonamides, pyrimidinylsalicylates and sulphonylaminocarbonyl-triazolinones (Shaner and Singh, 1997, Herbicide Activity: *Toxicol Biochem Mol Biol* 69-110); glyphosate resistant 5-enolpyruvylshikimate-3-phosphate (EPSPS) (Saroha et al. 1998, *J. Plant Biochemistry & Biotechnology* Vol 7:65-72);

Polynucleotides of interest includes genes that can be stacked or used in combination with other traits, such as but not limited to herbicide resistance or any other trait described herein. Polynucleotides of interest and/or traits can be stacked together in a complex trait locus as described in US20130263324 published 3 Oct. 2013 and in WO/2013/112686, published 1 Aug. 2013.

A polypeptide of interest includes any protein or polypeptide that is encoded by a polynucleotide of interest described herein.

Further provided are methods for identifying at least one plant cell, comprising in its genome, a polynucleotide of interest integrated at the target site. A variety of methods are available for identifying those plant cells with insertion into the genome at or near to the target site. Such methods can be viewed as directly analyzing a target sequence to detect any change in the target sequence, including but not limited to PCR methods, sequencing methods, nuclease digestion, Southern blots, and any combination thereof. See, for example, US20090133152 published 21 May 2009. The method also comprises recovering a plant from the plant cell comprising a polynucleotide of interest integrated into its genome. The plant may be sterile or fertile. It is recognized that any polynucleotide of interest can be provided, integrated into the plant genome at the target site, and expressed in a plant.

Optimization of Sequences for Expression in Plants

Methods are available in the art for synthesizing plant-preferred genes. See, for example, U.S. Pat. Nos. 5,380,831, and 5,436,391, and Murray et al. (1989) *Nucleic Acids Res.* 17:477-498. Additional sequence modifications are known to enhance gene expression in a plant host. These include, for example, elimination of: one or more sequences encoding spurious polyadenylation signals, one or more exon-intron splice site signals, one or more transposon-like repeats, and other such well-characterized sequences that may be deleterious to gene expression. The G-C content of the sequence may be adjusted to levels average for a given plant host, as calculated by reference to known genes expressed in the host plant cell. When possible, the sequence is modified to avoid one or more predicted hairpin secondary mRNA structures. Thus, "a plant-optimized nucleotide sequence" of the present disclosure comprises one or more of such sequence modifications.

Expression Elements

Any polynucleotide encoding a Cas protein, other CRISPR system component, or other polynucleotide disclosed herein may be functionally linked to a heterologous expression element, to facilitate transcription or regulation in a host cell. Such expression elements include but are not limited to: promoter, leader, intron, and terminator. Expression elements may be "minimal"—meaning a shorter sequence derived from a native source, that still functions as an expression regulator or modifier. Alternatively, an expression element may be "optimized"—meaning that its polynucleotide sequence has been altered from its native state in order to function with a more desirable characteristic in a particular host cell (for example, but not limited to, a bacterial promoter may be "maize-optimized" to improve its expression in corn plants). Alternatively, an expression element may be "synthetic"—meaning that it is designed in silico and synthesized for use in a host cell. Synthetic expression elements may be entirely synthetic, or partially synthetic (comprising a fragment of a naturally-occurring polynucleotide sequence).

It has been shown that certain promoters are able to direct RNA synthesis at a higher rate than others. These are called "strong promoters". Certain other promoters have been shown to direct RNA synthesis at higher levels only in particular types of cells or tissues and are often referred to as "tissue specific promoters", or "tissue-preferred promoters" if the promoters direct RNA synthesis preferably in certain tissues but also in other tissues at reduced levels.

A plant promoter includes a promoter capable of initiating transcription in a plant cell. For a review of plant promoters, see, Potenza et al., 2004, *In vitro Cell Dev Biol* 40:1-22; Porto et al., 2014, Molecular Biotechnology (2014), 56(1), 38-49.

Constitutive promoters include, for example, the core CaMV 35S promoter (Odell et al., (1985) *Nature* 313:810-2); rice actin (McElroy et al., (1990) *Plant Cell* 2:163-71); ubiquitin (Christensen et al., (1989) *Plant Mol Biol* 12:619-32; ALS promoter (U.S. Pat. No. 5,659,026) and the like.

Tissue-preferred promoters can be utilized to target enhanced expression within a particular plant tissue. Tissue-preferred promoters include, for example, WO2013103367 published 11 Jul. 2013, Kawamata et al., (1997) *Plant Cell Physiol* 38:792-803; Hansen et al., (1997) *Mol Gen Genet* 254:337-43; Russell et al., (1997) *Transgenic Res* 6:157-68; Rinehart et al., (1996) *Plant Physiol* 112:1331-41; Van Camp et al., (1996) *Plant Physiol* 112:525-35; Canevascini et al., (1996) *Plant Physiol* 112:513-524; Lam, (1994) *Results Probl Cell Differ* 20:181-96; and Guevara-Garcia et al., (1993) *Plant J* 4:495-505. Leaf-preferred promoters include, for example, Yamamoto et al., (1997) *Plant J* 12:255-65; Kwon et al., (1994) *Plant Physiol* 105:357-67; Yamamoto et al., (1994) *Plant Cell Physiol* 35:773-8; Gotor et al., (1993) *Plant J* 3:509-18; Orozco et al., (1993) *Plant Mol Biol* 23:1129-38; Matsuoka et al., (1993) *Proc. Natl. Acad. Sci. USA* 90:9586-90; Simpson et al., (1958) *EMBO J* 4:2723-9; Timko et al., (1988) *Nature* 318:57-8. Root-preferred promoters include, for example, Hire et al., (1992) *Plant Mol Biol* 20:207-18 (soybean root-specific glutamine synthase gene); Miao et al., (1991) *Plant Cell* 3:11-22 (cytosolic glutamine synthase (GS)); Keller and Baumgartner, (1991) *Plant Cell* 3:1051-61 (root-specific control element in the GRP 1.8 gene of French bean); Sanger et al., (1990) *Plant Mol Biol* 14:433-43 (root-specific promoter of *A. tumefaciens* mannopine synthase (MAS)); Bogusz et al., (1990) *Plant Cell* 2:633-41 (root-specific promoters isolated from *Parasponia andersonii* and *Trema tomentosa*); Leach and Aoyagi, (1991) *Plant Sci* 79:69-76 (*A. rhizogenes* rolC and rolD root-inducing genes); Teeri et al., (1989) *EMBO J* 8:343-50 (*Agrobacterium* wound-induced TR1' and TR2' genes); VfENOD-GRP3 gene promoter (Kuster et al., (1995) *Plant Mol Biol* 29:759-72); and ro1B promoter (Capana et al., (1994) *Plant Mol Biol* 25:681-91; phaseolin gene (Murai et al., (1983) *Science* 23:476-82; Sengopta-Gopalen et al., (1988) *Proc. Natl. Acad. Sci. USA* 82:3320-4). See also, U.S. Pat. Nos. 5,837,876; 5,750,386; 5,633,363; 5,459,252; 5,401,836; 5,110,732 and 5,023,179.

Seed-preferred promoters include both seed-specific promoters active during seed development, as well as seed-germinating promoters active during seed germination. See, Thompson et al., (1989) *BioEssays* 10:108. Seed-preferred promoters include, but are not limited to, Cim1 (cytokinin-induced message); cZ19B1 (maize 19 kDa zein); and milps (myo-inositol-1-phosphate synthase); and for example those disclosed in WO2000011177 published 2 Mar. 2000 and U.S. Pat. No. 6,225,529. For dicots, seed-preferred promoters include, but are not limited to, bean β-phaseolin, napin, β-conglycinin, soybean lectin, cruciferin, and the like. For monocots, seed-preferred promoters include, but are not limited to, maize 15 kDa zein, 22 kDa zein, 27 kDa gamma zein, waxy, shrunken 1, shrunken 2, globulin 1, oleosin, and nuc1. See also, WO2000012733 published 9 Mar. 2000, where seed-preferred promoters from END1 and END2 genes are disclosed.

Chemical inducible (regulated) promoters can be used to modulate the expression of a gene in a prokaryotic and eukaryotic cell or organism through the application of an exogenous chemical regulator. The promoter may be a chemical-inducible promoter, where application of the chemical induces gene expression, or a chemical-repressible promoter, where application of the chemical represses gene expression. Chemical-inducible promoters include, but are not limited to, the maize In2-2 promoter, activated by benzene sulfonamide herbicide safeners (De Veylder et al., (1997) *Plant Cell Physiol* 38:568-77), the maize GST promoter (GST-II-27, WO1993001294 published 21 Jan. 1993), activated by hydrophobic electrophilic compounds used as pre-emergent herbicides, and the tobacco PR-1a promoter (Ono et al., (2004) *Biosci Biotechnol Biochem* 68:803-7) activated by salicylic acid. Other chemical-regulated promoters include steroid-responsive promoters (see, for example, the glucocorticoid-inducible promoter (Schena et al., (1991) *Proc. Natl. Acad. Sci. USA* 88:10421-5; McNellis et al., (1998) *Plant J* 14:247-257); tetracycline-inducible and tetracycline-repressible promoters (Gatz et al., (1991) *Mol Gen Genet* 227:229-37; U.S. Pat. Nos. 5,814,618 and 5,789, 156).

Pathogen inducible promoters induced following infection by a pathogen include, but are not limited to those regulating expression of PR proteins, SAR proteins, beta-1, 3-glucanase, chitinase, etc.

A stress-inducible promoter includes the RD29A promoter (Kasuga et al. (1999) Nature Biotechnol. 17:287-91). One of ordinary skill in the art is familiar with protocols for simulating stress conditions such as drought, osmotic stress, salt stress and temperature stress and for evaluating stress tolerance of plants that have been subjected to simulated or naturally-occurring stress conditions.

Another example of an inducible promoter useful in plant cells, is the ZmCAS1 promoter, described in US20130312137 published 21 Nov. 2013.

New promoters of various types useful in plant cells are constantly being discovered; numerous examples may be found in the compilation by Okamuro and Goldberg, (1989) In *The Biochemistry of Plants*, Vol. 115, Stumpf and Conn, eds (New York, NY: Academic Press), pp. 1-82.

Developmental Genes (Morphogenic Factors)

Morphogenic factors (also called "developmental genes" or "dev genes", which are used synonymously throughout) are polynucleotides that act to enhance the rate, efficiency, and/or efficacy of targeted polynucleotide modification by a number of mechanisms, some of which are related to the capability of stimulating growth of a cell or tissue, including but not limited to promoting progression through the cell cycle, inhibiting cell death, such as apoptosis, stimulating cell division, and/or stimulating embryogenesis. The polynucleotides can fall into several categories, including but not limited to, cell cycle stimulatory polynucleotides, developmental polynucleotides, anti-apoptosis polynucleotides, hormone polynucleotides, transcription factors, or silencing constructs targeted against cell cycle repressors or pro-apoptotic factors. Methods and compositions for rapid and efficient transformation of plants by transforming cells of plant explants with an expression construct comprising a heterologous nucleotide encoding a morphogenic factor are described in US Patent Application Publication No. US2017/0121722 (published 4 May 2017).

A morphogenic factor (gene or protein) may be involved in plant metabolism, organ development, stem cell development, cell growth stimulation, organogenesis, somatic embryogenesis initiation, accelerated somatic embryo maturation, initiation and/or development of the apical meristem, initiation and/or development of shoot meristem, or a combination thereof.

In some aspects, the morphogenic factor is a molecule selected from one or more of the following categories: 1) cell cycle stimulatory polynucleotides including plant viral replicase genes such as RepA, cyclins, E2F, prolifera, cdc2 and cdc25; 2) developmental polynucleotides such as Lec1, Kn1 family, WUSCHEL, Zwille, BBM, Ainteguemnta (ANT), FUS3, and members of the Knotted family, such as Kn1, STM, OSH1, and SbH1; 3) anti-apoptosis polynucleotides such as CED9, Bcl2, Bcl-X(L), Bcl-W, A1, McL-1, Mac1, Boo, and Bax-inhibitors; 4) hormone polynucleotides such as IPT, TZS, and CKI-1; and 5) silencing constructs targeted against cell cycle repressors, such as Rb, CK1, prohibitin, and wee1, or stimulators of apoptosis such as APAF-1, bad, bax, CED-4, and caspase-3, and repressors of plant developmental transitions, such as Pickle and WD polycomb genes including FIE and Medea. The polynucleotides can be silenced by any known method such as antisense, RNA interference, cosuppression, chimerplasty, or transposon insertion.

In some aspects, the morphogenic factor is a member of the WUS/WOX gene family (WUS1, WUS2, WUS3, WOX2A, WOX4, WOX5, or WOX9) see U.S. Pat. Nos. 7,348,468 and 7,256,322 and United States Patent Application publications 20170121722 and 20070271628; Laux et al. (1996) Development 122:87-96; and Mayer et al. (1998) Cell 95:805-815; van der Graaff et al., 2009, Genome Biology 10:248; Dolzblasz et al., 2016, Mol. Plant 19:1028-39. The Wuschel protein, designated hereafter as WUS, plays a key role in the initiation and maintenance of the apical meristem, which contains a pool of pluripotent stem cells (Endrizzi, et al., (1996) Plant Journal 10:967-979; Laux, et al., (1996) Development 122:87-96; and Mayer, et al., (1998) Cell 95:805-815). Modulation of WUS/WOX is expected to modulate plant and/or plant tissue phenotype including plant metabolism, organ development, stem cell development, cell growth stimulation, organogenesis, somatic embryogenesis initiation, accelerated somatic embryo maturation, initiation and/or development of the apical meristem, initiation and/or development of shoot meristem, or a combination thereof. WUS encodes a novel homeodomain protein which presumably functions as a transcriptional regulator (Mayer, et al., (1998) Cell 95:805-815). The stem cell population of Arabidopsis shoot meristems is believed to be maintained by a regulatory loop between the CLAVATA (CLV) genes which promote organ initiation and the WUS gene which is required for stem cell identity, with the CLV genes repressing WUS at the transcript level, and WUS expression being sufficient to induce meristem cell identity and the expression of the stem cell marker CLV3 (Brand, et al., (2000) Science 289:617-619; Schoof, et al., (2000) Cell 100:635-644). Expression of Arabidopsis WUS can induce stem cells in vegetative tissues, which can differentiate into somatic embryos (Zuo, et al. (2002) Plant J 30:349-359). Also of interest in this regard would be a MYB 118 gene (see U.S. Pat. No. 7,148,402), MYB 115 gene (see Wang et al. (2008) Cell Research 224-235), a BABYBOOM gene (BBM; see Boutilier et al. (2002) Plant Cell 14:1737-1749), or a CLAVATA gene (see, for example, U.S. Pat. No. 7,179,963).

In some embodiments, the morphogenic factor or protein is a member of the AP2/ERF family of proteins. The AP2/ERF family of proteins is a plant-specific class of putative transcription factors that regulate a wide variety of developmental processes and are characterized by the presence of an AP2 DNA binding domain that is predicted to form an amphipathic alpha helix that binds DNA (PFAM Accession PF00847). The AP2 domain was first identified in APETALA2, an Arabidopsis protein that regulates meristem identity, floral organ specification, seed coat development, and floral homeotic gene expression. The AP2/ERF proteins have been subdivided into distinct subfamilies based on the presence of conserved domains. Initially, the family was divided into two subfamilies based on the number of DNA binding domains, with the ERF subfamily having one DNA binding domain, and the AP2 subfamily having 2 DNA binding domains. As more sequences were identified, the family was subsequently subdivided into five subfamilies: AP2, DREB, ERF, RAV, and others. (Sakuma et al. (2002) Biochem Biophys Res Comm 290:998-1009).

Members of the APETALA2 (AP2) family of proteins function in a variety of biological events, including but not limited to, development, plant regeneration, cell division, embryogenesis, and morphogenic (see, e.g., Riechmann and Meyerowitz (1998) Biol Chem 379:633-646; Saleh and Pagés (2003) Genetika 35:37-50 and Database of Arabidopsis Transcription Factors at daft.cbi.pku.edu.cn). The AP2 family includes, but is not limited to, AP2, ANT, Glossy 15, AtBBM, BnBBM, and maize ODP2/BBM.

Other morphogenic factors useful in the present disclosure include, but are not limited to, Ovule Development Protein 2 (ODP2) polypeptides, and related polypeptides, e.g., Babyboom (BBM) protein family proteins. In an aspect, the polypeptide comprising the two AP2-DNA binding domains is an ODP2, BBM2, BMN2, or BMN3 polypeptide. The ODP2 polypeptides of the disclosure contain two predicted APETALA2 (AP2) domains and are members of the AP2 protein family (PFAM Accession PF00847). The AP2 family of putative transcription factors has been shown to regulate a wide range of developmental processes, and the family members are characterized by the presence of an AP2 DNA binding domain. This conserved core is predicted to form an amphipathic alpha helix that binds DNA. The AP2 domain was first identified in APETALA2, an Arabidopsis protein that regulates meristem identity, floral organ specification, seed coat development, and floral homeotic gene expression. The AP2 domain has now been found in a variety of proteins. The ODP2 polypeptides share homology with several polypeptides within the AP2 family, e.g., see FIG. 1 of U.S. Pat. No. 8,420,893, which is incorporated herein by reference in its entirety, provides an alignment of the maize and rice ODP2 polypeptides with eight other proteins having two AP2 domains. A consensus sequence of all proteins appearing in the alignment of U.S. Pat. No. 8,420,893 is also provided in FIG. 1 therein.

In some embodiments, the morphogenic factor is a babyboom (BBM) polypeptide, which is a member of the AP2 family of transcription factors. The BBM protein from Arabidopsis (AtBBM) is preferentially expressed in the developing embryo and seeds and has been shown to play a central role in regulating embryo-specific pathways. Overexpression of AtBBM has been shown to induce spontaneous formation of somatic embryos and cotyledon-like structures on seedlings. See, Boutiler et al. (2002) The Plant Cell 14:1737-1749. The maize BBM protein also induces embryogenesis and promotes transformation (See, U.S. Pat. No. 7,579,529, which is herein incorporated by reference in its entirety). Thus, BBM polypeptides stimulate proliferation, induce embryogenesis, enhance the regenerative capacity of a plant, enhance transformation, and as demonstrated herein, enhance rates of targeted polynucleotide modification. As used herein "regeneration" refers to a morphogenic response that results in the production of new tissues, organs, embryos, whole plants or parts of whole plants that are derived from a single cell or a group of cells. Regeneration may proceed indirectly via a callus phase or directly, without an intervening callus phase. "Regenerative capacity" refers to the ability of a plant cell to undergo regeneration.

Other morphogenic factors useful in the present disclosure include, but are not limited to, LEC1 (Lotan et al., 1998, Cell 93:1195-1205), LEC2 (Stone et al., 2008, PNAS 105: 3151-3156; Belide et al., 2013, Plant Cell Tiss. Organ Cult 113:543-553), KN1/STM (Sinha et al., 1993. Genes Dev 7:787-795), the IPT gene from Agrobacterium (Ebinuma and Komamine, 2001, In vitro Cell. Dev Biol—Plant 37:103-113), MONOPTEROS-DELTA (Ckurshumova et al., 2014, New Phytol. 204:556-566), the Agrobacterium AV-6b gene (Wabiko and Minemura 1996, Plant Physiol. 112:939-951), the combination of the Agrobacterium IAA-h and IAA-m genes (Endo et al., 2002, Plant Cell Rep., 20:923-928), the Arabidopsis SERK gene (Hecht et al., 2001, Plant Physiol. 127:803-816), the Arabiopsis AGL15 gene (Harding et al., 2003, Plant Physiol. 133:653-663), and the FUSCA gene (Castle and Meinke, Plant Cell 6:25-41), and the PICKLE gene (Ogas et al., 1999, PNAS 96:13839-13844).

The morphogenic factor can be derived from a monocot. In various aspects, the morphogenic factor is derived from barley, maize, millet, oats, rice, rye, Setaria sp., sorghum, sugarcane, switchgrass, triticale, turfgrass, or wheat.

The morphogenic factor can be derived from a dicot. The morphogenic factor can be derived from kale, cauliflower, broccoli, mustard plant, cabbage, pea, clover, alfalfa, broad bean, tomato, cassava, soybean, canola, alfalfa, sunflower, safflower, tobacco, Arabidopsis, or cotton.

The present disclosure encompasses isolated or substantially purified polynucleotide or polypeptide morphogenic factor compositions.

The morphogenic factor may be altered in various ways including amino acid substitutions, deletions, truncations, and insertions. Methods for such manipulations are generally known in the art. For example, amino acid sequence variants of the morphogenic proteins can be prepared by mutations in the DNA. Methods for mutagenesis and nucleotide sequence alterations are well known in the art. See, for example, Kunkel (1985) Proc. Natl. Acad. Sci. USA 82:488-492; Kunkel et al. (1987) Methods in Enzymol. 154:367-382; U.S. Pat. No. 4,873,192; Walker and Gaastra, eds. (1983) Techniques in Molecular Biology (MacMillan Publishing Company, New York) and the references cited therein. Guidance as to appropriate amino acid substitutions that do not affect biological activity of the protein of interest may be found in the model of Dayhoff et al. (1978) Atlas of Protein Sequence and Structure (Natl. Biomed. Res. Found., Washington, D.C.), herein incorporated by reference. Conservative substitutions, such as exchanging one amino acid with another having similar properties, may be optimal.

In some embodiments, polynucleotides or polypeptides having homology to a known morphogenic factor and/or sharing conserved functional domains can be identified by screening sequence databases using programs such as BLAST, or using standard nucleic acid hybridization techniques known in the art, for example as described in Tijssen (1993) Laboratory Techniques in Biochemistry and Molecular Biology—Hybridization with Nucleic Acid Probes, Part I, Chapter 2 (Elsevier, NY); Ausubel et al., eds. (1995) Current Protocols in Molecular Biology, Chapter 2 (Greene Publishing and Wiley-Interscience, NY); and, Sambrook et al. (1989) Molecular Cloning: A Laboratory Manual (2d ed., Cold Spring Harbor Laboratory Press, Plainview, NY).

In some aspects, the morphogenic factor is selected from the group consisting of: SEQID NOs: 1-5, 11-16, 22, and 23-47. In some aspects, the morphogenic protein is selected from the group consisting of: SEQID NOs: 6-10, 17-21, and 48-73.

In some aspects, a plurality of morphogenic factors is selected. When multiple morphogenic factors are used, the polynucleotides encoding each of the factors can be present on the same expression cassette or on separate expression cassettes. Likewise, the polynucleotide(s) encoding the morphogenic factor(s) and the polynucleotide encoding the double-strand break-inducing agent can be located on the same or different expression cassettes. When two or more factors are coded for by separate expression cassettes, the expression cassettes can be provided to the organism simultaneously or sequentially.

In some aspects, the expression of the morphogenic factor is transient. In some aspects, the expression of the morphogenic factor is constitutive. In some aspects, the expression of the morphogenic factor is specific to a particular tissue or cell type. In some aspects, the expression of the morphogenic factor is temporally regulated. In some aspects, the expression of the morphogenic factor is regulated by an environmental condition, such as temperature, time of day, or other factor. In some aspects, the expression of the morphogenic factor is stable. In some aspects, expression of the morphogenic factor is controlled. The controlled expression may be a pulsed expression of the morphogenic factor for a particular period of time. Alternatively, the morphogenic factor may be expressed in only some transformed cells and not expressed in others. The control of expression of the morphogenic factor can be achieved by a variety of methods as disclosed herein.

Helper Plasmids

*Agrobacterium*, a natural plant pathogen, has been widely used for the transformation of dicotyledonous plants and more recently for transformation of monocotyledonous plants. The advantage of the *Agrobacterium*-mediated gene transfer system is that it offers the potential to regenerate transgenic cells at relatively high frequencies without a significant reduction in plant regeneration rates. Moreover, the process of DNA transfer to the plant genome is well characterized relative to other DNA delivery methods. DNA transferred via *Agrobacterium* is less likely to undergo any major rearrangements than is DNA transferred via direct delivery, and it integrates into the plant genome often in single or low copy numbers.

The most commonly used *Agrobacterium*-mediated gene transfer system is a binary transformation vector system where the *Agrobacterium* has been engineered to include a disarmed, or nononcogenic, Ti helper plasmid, which encodes the vir functions necessary for DNA transfer, and a much smaller separate plasmid called the binary vector plasmid, which carries the transferred DNA, or the T-DNA region. The T-DNA is defined by sequences at each end, called T-DNA borders, which play an important role in the production of T-DNA and in the transfer process.

Binary vectors are vectors in which the virulence genes are placed on a different plasmid than the one carrying the T-DNA region (Bevan, 1984, Nucl. Acids. Res. 12: 8711-8721). The development of T-DNA binary vectors has made the transformation of plant cells easier as they do not require recombination. The finding that some of the virulence genes exhibited gene dosage effects (Jin et al., J. Bacteriol. (1987) 169:4417-4425) led to the development of a superbinary vector, which carried additional virulence genes (Komari, T., et al., Plant Cell Rep. (1990), 9:303-306). These early superbinary vectors carried a large "vir" fragment (~14.8 kbp) from the hypervirulenece Ti plasmid, pTiBo542, which had been introduced into a standard binary vector (ibid). The superbinary vectors resulted in vastly improved plant transformation. For example, Hiei, Y., et al. (Plant J. (1994) 6:271-282) described efficient transformation of rice by *Agrobacterium*, and subsequently there were reports of using this system for maize, barley and wheat (Ishida, Y., et al., Nat. Biotech. (1996) 14:745-750; Tingay, S., et al., Plant J. (1997) 11:1369-1376; and Cheng, M., et al., Plant Physiol. (1997) 115:971-980; see also U.S. Pat. No. 5,591,616 to Hiei et al). Examples of prior superbinary vectors include pTOK162 (Japanese Patent Appl. (Kokai) No. 4-222527, EP-A-504,869, EP-A-604,662, and U.S. Pat. No. 5,591,616) and pTOK233 (see Komari, T., ibid; and Ishida, Y., et al., ibid).

The present disclosure comprises methods and compositions utilizing superbinary vectors comprising vir genes. In various aspects, the present disclosure provides a vector comprising: (a) an origin of replication for propagation and stable maintenance in *Escherichia coli*; (b) an origin of replication for propagation and stable maintenance in *Agrobacterium* spp.; (c) a selectable marker gene; and (d) *Agrobacterium* spp. virulence genes virB1-B11; virC1-C2; virD1-D2; and virG genes. In an aspect, the vector further comprises *Agrobacterium* spp. virulence genes virA, virD3, virD4, virD5, virE1, virE2, virE3, virH, virH1, virH2, virK, virL, virM, virP, or virQ, or combinations thereof. In an aspect, the vector comprises *Agrobacterium* sp. virulence genes virB1-B11, virC1-C2; virD1-D2, and virG genes. In another aspect, the vector comprises *Agrobacterium* sp. virulence genes virA, virB1-B11, virC1-C2; virD1-D5, virE1-E3, virG, and virJ genes.

*Agrobacteria* with helper plasmids, such as pVIR9, pVIR7, or pVIR10, can significantly improve the transient protein expression, transient T-DNA delivery, somatic embryo phenotypes, transformation frequencies, recovery of quality events, and usable quality events in different plant lines (WO2017078836A1, published 11 May 2017).

VIR genes are also used for the improvement of transformation with *Ochrobactrum*, for example as disclosed in US20180216123, published 2 Aug. 2018.

Introduction of System Components into a Cell

The methods and compositions described herein do not depend on a particular method for introducing a sequence into an organism or cell, only that the polynucleotide or polypeptide gains access to the interior of at least one cell of the organism. Introducing includes reference to the incorporation of a nucleic acid into a eukaryotic or prokaryotic cell where the nucleic acid may be incorporated into the genome of the cell, and includes reference to the transient (direct) provision of a nucleic acid, protein or ribonucleoprotein complex to the cell.

Methods for introducing polynucleotides or polypeptides or a polynucleotide-protein complex into cells or organisms are known in the art including, but not limited to, microinjection, electroporation, stable transformation methods, transient transformation methods, ballistic particle acceleration (particle bombardment), whiskers mediated transformation, *Agrobacterium*-mediated transformation, direct gene transfer, viral-mediated introduction, transfection, transduction, cell-penetrating peptides, mesoporous silica nanoparticle (MSN)-mediated direct protein delivery, topical applications, sexual crossing, sexual breeding, and any combination thereof. General methods for the introduction of polynucleotides into a cell for transformation, for example *Agrobacterium*-mediated transformation, *Ochrobactrum*-mediated transformation, and particle bombardment-mediated transformation of cells are known in the art.

For example, the guide polynucleotide (guide RNA, crNucleotide+tracrNucleotide, guide DNA and/or guide RNA-DNA molecule) can be introduced into a cell directly (transiently) as a single stranded or double stranded polynucleotide molecule. The guide RNA (or crRNA+tracrRNA) can also be introduced into a cell indirectly by introducing a recombinant DNA molecule comprising a heterologous nucleic acid fragment encoding the guide RNA (or crRNA+tracrRNA), operably linked to a specific promoter that is capable of transcribing the guide RNA (crRNA+tracrRNA molecules) in said cell. The specific promoter can be, but is not limited to, a RNA polymerase III promoter, which allow for transcription of RNA with precisely defined, unmodified, 5'- and 3'-ends (Ma et al., 2014, *Mol. Ther. Nucleic Acids* 3:e161; DiCarlo et al., 2013, *Nucleic Acids Res.* 41: 4336-4343; WO2015026887, published 26 Feb. 2015). Any promoter capable of transcribing the guide RNA in a cell can be used and includes a heat shock/heat inducible promoter operably linked to a nucleotide sequence encoding the guide RNA.

Protocols for introducing polynucleotides, polypeptides or polynucleotide-protein complexes into eukaryotic cells, such as plants or plant cells are known and include microinjection (Crossway et al., (1986) *Biotechniques* 4:320-34 and U.S. Pat. No. 6,300,543), meristem transformation (U.S. Pat. No. 5,736,369), electroporation (Riggs et al., (1986) *Proc. Natl. Acad. Sci. USA* 83:5602-6, *Agrobacterium*-mediated transformation (U.S. Pat. Nos. 5,563,055 and 5,981,840), whiskers mediated transformation (Ainley et al. 2013, Plant *Biotechnology Journal* 11:1126-1134; Shaheen A. and M. Arshad 2011 Properties and Applications of Silicon Carbide (2011), 345-358 Editor(s): Gerhardt, Rosario. Publisher: InTech, Rijeka, Croatia. CODEN: 69PQBP; ISBN: 978-953-307-201-2), direct gene transfer (Paszkowski et al., (1984) *EMBO J* 3:2717-22), and ballistic particle acceleration (U.S. Pat. Nos. 4,945,050; 5,879,918; 5,886,244; 5,932,782; Tomes et al., (1995) "Direct DNA Transfer into Intact Plant Cells via Microprojectile Bombardment" in *Plant Cell, Tissue, and Organ Culture: Fundamental Methods*, ed. Gamborg & Phillips (Springer-Verlag, Berlin); McCabe et al., (1988) *Biotechnology* 6:923-6; Weissinger et al., (1988) *Ann Rev Genet* 22:421-77; Sanford et al., (1987) *Particulate Science and Technology* 5:27-37 (onion); Christou et al., (1988) *Plant Physiol* 87:671-4 (soybean); Finer and McMullen, (1991) *In vitro Cell Dev Biol* 27P: 175-82 (soybean); Singh et al., (1998) *Theor Appl Genet* 96:319-24 (soybean); Datta et al., (1990) *Biotechnology* 8:736-40 (rice); Klein et al., (1988) *Proc. Natl. Acad. Sci. USA* 85:4305-9 (maize); Klein et al., (1988) *Biotechnology* 6:559-63 (maize); U.S. Pat. Nos. 5,240,855; 5,322,783 and 5,324,646; Klein et al., (1988) *Plant Physiol* 91:440-4 (maize); Fromm et al., (1990) *Biotechnology* 8:833-9 (maize); Hooykaas-Van Slogteren et al., (1984) *Nature* 311:763-4; U.S. Pat. No. 5,736,369 (cereals); Bytebier et al., (1987) *Proc. Natl. Acad. Sci. USA* 84:5345-9 (Liliaceae); De Wet et al., (1985) in *The Experimental Manipulation of Ovule Tissues*, ed. Chapman et al., (Longman, New York), pp. 197-209 (pollen); Kaeppler et al., (1990) *Plant Cell* Rep 9:415-8) and Kaeppler et al., (1992) *Theor Appl Genet* 84:560-6 (whisker-mediated transformation); D'Halluin et al., (1992) *Plant Cell* 4:1495-505 (electroporation); Li et al., (1993) *Plant Cell* Rep 12:250-5; Christou and Ford (1995) Annals Botany 75:407-13 (rice) and Osjoda et al., (1996) *Nat Biotechnol* 14:745-50 (maize via *Agrobacterium tumefaciens*).

Alternatively, polynucleotides may be introduced into cells by contacting cells or organisms with a virus or viral nucleic acids. Generally, such methods involve incorporating a polynucleotide within a viral DNA or RNA molecule. In some examples a polypeptide of interest may be initially synthesized as part of a viral polyprotein, which is later processed by proteolysis in vivo or in vitro to produce the desired recombinant protein. Methods for introducing polynucleotides into plants and expressing a protein encoded therein, involving viral DNA or RNA molecules, are known, see, for example, U.S. Pat. Nos. 5,889,191, 5,889,190, 5,866,785, 5,589,367 and 5,316,931.

The methods provided herein rely upon the use of bacteria-mediated and/or biolistic-mediated gene transfer to produce regenerable plant cells. Bacterial strains useful in the methods of the disclosure include, but are not limited to, a disarmed *Agrobacteria*, an *Ochrobactrum* bacteria or a Rhizobiaceae bacteria. Standard protocols for particle bombardment (Finer and McMullen, 1991, In Vitro Cell Dev. Biol.—Plant 27:175-182), *Agrobacterium*-mediated transformation (Jia et al., 2015, Int J. Mol. Sci. 16:18552-18543; US2017/0121722 incorporated herein by reference in its entirety), or *Ochrobactrum*-mediated transformation (US2018/0216123 incorporated herein by reference in its entirety) can be used with the methods and compositions of the disclosure.

The polynucleotide or recombinant DNA construct can be provided to or introduced into a prokaryotic and eukaryotic cell or organism using a variety of transient transformation methods. Such transient transformation methods include, but are not limited to, the introduction of the polynucleotide construct directly into the plant.

Nucleic acids and proteins can be provided to a cell by any method including methods using molecules to facilitate the uptake of anyone or all components of a guided Cas system (protein and/or nucleic acids), such as cell-penetrating peptides and nanocarriers. See also US20110035836 published 10 Feb. 2011, and EP2821486A1 published 7 Jan. 2015.

Other methods of introducing polynucleotides into a prokaryotic and eukaryotic cell or organism or plant part can be used, including plastid transformation methods, and the methods for introducing polynucleotides into tissues from seedlings or mature seeds.

Stable transformation is intended to mean that the nucleotide construct introduced into an organism integrates into a genome of the organism and is capable of being inherited by the progeny thereof. Transient transformation is intended to mean that a polynucleotide is introduced into the organism and does not integrate into a genome of the organism or a polypeptide is introduced into an organism. Transient transformation indicates that the introduced composition is only temporarily expressed or present in the organism.

A variety of methods are available to identify those cells having an altered genome at or near a target site without using a screenable marker phenotype. Such methods can be viewed as directly analyzing a target sequence to detect any change in the target sequence, including but not limited to PCR methods, sequencing methods, nuclease digestion, Southern blots, and any combination thereof.

Cells and Organisms

The presently disclosed polynucleotides and polypeptides can be introduced into a cell. Cells include, but are not limited to, human, non-human, animal, mammalian, bacterial, protist, fungal, insect, yeast, non-conventional yeast, and plant cells, as well as plants and seeds produced by the methods described herein. In some aspects, the cell of the organism is a reproductive cell, a somatic cell, a meiotic cell, a mitotic cell, a stem cell, or a pluripotent stem cell. Any cell from any organism may be used with the compositions and methods described herein, including monocot and dicot plants, and plant elements.

Animal Cells

The presently disclosed polynucleotides and polypeptides can be introduced into an animal cell. Animal cells can include, but are not limited to: an organism of a phylum including chordates, arthropods, mollusks, annelids, cnidarians, or echinoderms; or an organism of a class including mammals, insects, birds, amphibians, reptiles, or fishes. In some aspects, the animal is human, mouse, *C. elegans*, rat, fruit fly (*Drosophila* spp.), zebrafish, chicken, dog, cat, guinea pig, hamster, chicken, Japanese ricefish, sea lamprey, pufferfish, tree frog (e.g., *Xenopus* spp.), monkey, or chimpanzee. Particular cell types that are contemplated include haploid cells, diploid cells, reproductive cells, neurons, muscle cells, endocrine or exocrine cells, epithelial cells, muscle cells, tumor cells, embryonic cells, hematopoietic cells, bone cells, germ cells, somatic cells, stem cells, pluripotent stem cells, induced pluripotent stem cells, progenitor cells, meiotic cells, and mitotic cells. In some aspects, a plurality of cells from an organism may be used.

The compositions and methods described herein may be used to edit the genome of an animal cell in various ways. In one aspect, it may be desirable to delete one or more nucleotides. In another aspect, it may be desirable to insert one or more nucleotides. In one aspect, it may be desirable to replace one or more nucleotides. In another aspect, it may be desirable to modify one or more nucleotides via a covalent or non-covalent interaction with another atom or molecule.

Genome modification may be used to effect a genotypic and/or phenotypic change on the target organism. Such a change is preferably related to an improved phenotype of interest or a physiologically-important characteristic, the correction of an endogenous defect, or the expression of some type of expression marker. In some aspects, the phenotype of interest or physiologically-important characteristic is related to the overall health, fitness, or fertility of the animal, the ecological fitness of the organism, or the relationship or interaction of the organism with other organisms in its environment.

Cells that have been genetically modified using the compositions or methods described herein may be transplanted to a subject for purposes such as gene therapy, e.g. to treat a disease, or as an antiviral, antipathogenic, or anticancer therapeutic, for the production of genetically modified organisms in agriculture, or for biological research.

Plant Cells and Plants

Examples of monocot plants that can be used include, but are not limited to, corn (*Zea mays*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), wheat (*Triticum* species, for example *Triticum aestivum, Triticum monococcum*), sugarcane (*Saccharum* spp.), oats (*Avena*), barley (*Hordeum*), switchgrass (*Panicum virgatum*), pineapple (*Ananas comosus*), banana (*Musa* spp.), palm, ornamentals, turfgrasses, and other grasses.

Examples of dicot plants that can be used include, but are not limited to, soybean (*Glycine max*), *Brassica* species (for example but not limited to: oilseed rape or Canola) (*Brassica napus, B. campestris, Brassica rapa, Brassica. juncea*), alfalfa (*Medicago sativa*),), tobacco (*Nicotiana tabacum*), Arabidopsis (*Arabidopsis thaliana*), sunflower (*Helianthus annuus*), cotton (*Gossypium arboreum, Gossypium barbadense*), and peanut (*Arachis hypogaea*), tomato (*Solanum lycopersicum*), and potato (*Solanum tuberosum*).

Additional plants that can be used include safflower (*Carthamus tinctorius*), sweet potato (*Ipomoea batatus*), cassava (*Manihot esculenta*), coffee (*Coffea* spp.), coconut (*Cocos nucifera*), citrus trees (Citrus spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), vegetables, ornamentals, and conifers.

Vegetables that can be used include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum.

Conifers that may be used include pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow cedar (*Chamaecyparis nootkatensis*).

In certain embodiments of the disclosure, a fertile plant is a plant that produces viable male and female gametes and is self-fertile. Such a self-fertile plant can produce a progeny plant without the contribution from any other plant of a gamete and the genetic material comprised therein. Other embodiments of the disclosure can involve the use of a plant that is not self-fertile because the plant does not produce male gametes, or female gametes, or both, that are viable or otherwise capable of fertilization.

The present disclosure finds use in the breeding of plants comprising one or more introduced traits, or edited genomes.

A non-limiting example of how two traits can be stacked into the genome at a genetic distance of, for example, 5 cM from each other is described as follows: A first plant comprising a first transgenic target site integrated into a first DSB target site within the genomic window and not having the first genomic locus of interest is crossed to a second transgenic plant, comprising a genomic locus of interest at a different genomic insertion site within the genomic window and the second plant does not comprise the first transgenic target site. About 5% of the plant progeny from this cross will have both the first transgenic target site integrated into a first DSB target site and the first genomic locus of interest integrated at different genomic insertion sites within the genomic window. Progeny plants having both sites in the defined genomic window can be further crossed with a third transgenic plant comprising a second transgenic target site integrated into a second DSB target site and/or a second genomic locus of interest within the defined genomic window and lacking the first transgenic target site and the first genomic locus of interest. Progeny are then selected having the first transgenic target site, the first genomic locus of interest and the second genomic locus of interest integrated at different genomic insertion sites within the genomic window. Such methods can be used to produce a transgenic plant comprising a complex trait locus having at least 1, 2, 3, 4, 5, 6, 7, 8, 9, 10, 11, 12, 13, 14, 15, 16, 17, 19, 19, 20, 21, 22, 23, 24, 25, 26, 27, 28, 29, 30, 31 or more transgenic target sites integrated into DSB target sites and/or genomic loci of interest integrated at different sites within the genomic window. In such a manner, various complex trait loci can be generated.

Non-Limiting Aspects

In one or more embodiments, the invention includes:

Aspect 1: A method of incorporating a polynucleotide of interest at a target site of a plant cell, the method comprising providing to the plant cell a first guide RNA, a second guide RNA, and an *Agrobacterium* that comprises: a helper plasmid, and one or more recombinant construct(s) comprising: a gene encoding a Cas endonuclease, at least one polynucleotide encoding a morphogenic factor, and a donor DNA cassette, comprising the polynucleotide of interest, flanked by a set of polynucleotides comprising two polynucleotides each comprising a first target sequence; wherein the first target sequence is capable of selectively hybridizing with the first guide RNA; wherein the first guide RNA forms a first complex with a Cas endonuclease, wherein the first complex binds to and cleaves the donor DNA cassette to release the polynucleotide of interest; wherein the second guide RNA forms a second complex with a Cas endonuclease, wherein the second complex binds to and cleaves a second target sequence at or near the target site of the plant cell; the method further comprising selecting at least one plant cell that comprises the polynucleotide of interest at the target site of the plant cell.

Aspect 2: A method of modulating a trait of interest in a plant, the method comprising providing to the plant cell a first guide RNA, a second guide RNA, and an *Agrobacterium* that comprises: a helper plasmid, and one or more recombinant construct(s) comprising: a gene encoding a Cas endonuclease, at least one polynucleotide encoding a morphogenic factor, and a donor DNA cassette, comprising the polynucleotide of interest, flanked by a set of polynucleotides comprising two polynucleotides each comprising a first target sequence; wherein the first target sequence is capable of selectively hybridizing with the first guide RNA; wherein the first guide RNA forms a first complex with a Cas endonuclease, wherein the first complex binds to and cleaves the donor DNA cassette to release the polynucleotide of interest; wherein the second guide RNA forms a second complex with a Cas endonuclease, wherein the second complex binds to and cleaves a second target sequence at or near the target site of the plant cell; the method further comprising regenerating a plant or plant part from the plant cell, and identifying at least one trait of agronomic importance that is modulated in said plant or plant part, as compared to an isoline plant or plant part not comprising, or derived from, a cell whose genome was edited with the construct of (b).

Aspect 3: The method of Aspect 1 or Aspect 2, wherein the amino acid sequence of the Cas endonuclease that forms a complex with the first guide RNA is identical to the amino acid sequence of the Cas endonuclease that forms a complex with the second guide RNA.

Aspect 4: The method of Aspect 1 or Aspect 2, wherein the amino acid sequence of the Cas endonuclease that forms a complex with the first guide RNA is not identical to the amino acid sequence of the Cas endonuclease that forms a complex with the second guide RNA.

Aspect 5: The method of Aspect 1 or Aspect 2, wherein the Cas endonuclease that forms a complex with the first guide RNA or the Cas endonuclease that forms a complex with the second guide RNA is encoded by the gene of (b)(i).

Aspect 6: The method of Aspect 1 or Aspect 2, wherein the first guide RNA and the second guide RNA are capable of selectively hybridizing with an identical DNA sequence.

Aspect 7: The method of Aspect 1 or Aspect 2, wherein the first guide RNA and the second guide RNA are capable of selectively hybridizing with non-identical DNA sequences.

Aspect 8: The method of Aspect 1 or Aspect 2, wherein the first target sequence is greater than or equal to 90% identical to the second target sequence, over the full length of one the first target sequence.

Aspect 9: The method of Aspect 1 or Aspect 2, wherein the first target sequence is less than 90% identical to the second target sequence, over the full length of one of the first target sequence.

Aspect 10: The method of Aspect 1 or Aspect 2, wherein at least one of the first or second guide RNAs is provided as a ribonucleotide.

Aspect 11: The method of Aspect 1 or Aspect 2, wherein at least one of the first or second guide RNAs is provided as a deoxyribonucleotide.

Aspect 12: The method of Aspect 1 or Aspect 2, wherein the first target sequence comprises a PAM sequence that is capable of being recognized by a Cas endonuclease.

Aspect 13: The method of Aspect 1 or Aspect 2, wherein the first target sequence comprises a PAM sequence that is capable of being recognized by the Cas endonuclease of (b)(i).

Aspect 14: The method of Aspect 1 or Aspect 2, wherein the first target sequence comprises a PAM sequence that is inverted.

Aspect 15: The method of Aspect 3, wherein the second target sequence is capable of selectively hybridizing with the same guide RNA sequence to which the first target sequence is capable of selectively hybridizing.

Aspect 16: The method of Aspect 3, wherein the second target site is not identical to the first target site.

Aspect 17: The method of Aspect 3, wherein the second target site is identical to the first target site.

Aspect 18: The method of Aspect 1 or Aspect 2, wherein the helper plasmid is a superbinary vector.

Aspect 19: The method of Aspect 18, wherein the superbinary vector is pVIR7, pVIR9, or pVIR10.

Aspect 20: The method of Aspect 1 or Aspect 2, wherein the morphogenic factor is BBM, WUS, or a combination of BBM and WUS.

Aspect 21: The method of Aspect 1 or Aspect 2, comprising BBM and WUS.

Aspect 22: The method of Aspect 1 or Aspect 2, wherein the recombinant construct of (b) further comprises a selectable marker gene.

Aspect 23: The method of Aspect 22, wherein the selectable marker gene is part of the donor DNA cassette.

Aspect 24: The method of Aspect 22, wherein the selectable marker gene is outside of the donor DNA cassette.

Aspect 25: The method of Aspect 1 or Aspect 2, wherein the plant cell is selected from the group consisting of: *Zea mays, Sorghum bicolor, Sorghum vulgare, Triticum aestivum, Medicago sativa, Oryza sativa, Setaria italica, Saccharum* spp., *Helianthus annuus, Glycine max, Nicotiana tabacum, Gossypium barbadense, Gossypium hirsutum, Manihot esculenta, Beta vulgaris, Brassica* spp., and *Arabidposis thaliana*.

Aspect 26: The method of Aspect 2, wherein the trait of interest is selected from the group consisting of: selectable marker resistance, disease resistance, drought tolerance, heat tolerance, cold tolerance, salinity tolerance, metal tolerance, herbicide tolerance, improved water use efficiency, improved nitrogen utilization, improved nitrogen fixation, pest resistance, herbivore resistance, pathogen resistance, yield improvement, health enhancement, vigor improvement, growth improvement, photosynthetic capability improvement, nutrition enhancement, altered protein composition, altered oil composition, increased biomass, increased shoot length, increased root length, improved root architecture, modulation of a metabolite, modulation of the proteome, increased seed weight, altered seed carbohydrate composition, altered seed oil composition, altered seed protein composition, altered seed nutrient composition, improved fertility, improved fecundity, improved environmental tolerance, improved vigor, improved disease resistance, improved disease tolerance, improved tolerance to a heterologous molecule, improved fitness, improved physical characteristic, greater mass, increased production of a biochemical molecule, decreased production of a biochemical molecule, upregulation of a gene, downregulation of a gene, upregulation of a biochemical pathway, downregulation of a biochemical pathway, stimulation of cell reproduction, and suppression of cell reproduction.

Aspect 27: A synthetic composition comprising a plant cell, a first guide RNA, a second guide RNA, and an *Agrobacterium* that comprises: a helper plasmid, and one or more recombinant construct(s) comprising: a gene encoding for a Cas endonuclease, at least one polynucleotide encoding a morphogenic factor, and a donor DNA cassette, comprising a polynucleotide of interest, flanked by a set of polynucleotides comprising two polynucleotides each comprising a first target sequence, wherein the first target sequence is capable of selectively hybridizing with the first guide RNA.

Aspect 28: The synthetic composition of Aspect 27, wherein the plant cell further comprises a second target site that comprises a polynucleotide sequence capable of being recognized and cleaved by a complex comprising a Cas endonuclease Aspect 29: The synthetic composition of Aspect 28, wherein the Cas endonuclease is encoded by the gene.

Aspect 30: The synthetic composition of Aspect 27, wherein the amino acid sequence of the Cas endonuclease that forms a complex with the first guide RNA is identical to the amino acid sequence of the Cas endonuclease that forms a complex with the second guide RNA.

Aspect 31: The synthetic composition of Aspect 27, wherein the amino acid sequence of the Cas endonuclease that forms a complex with the first guide RNA is not identical to the amino acid sequence of the Cas endonuclease that forms a complex with the second guide RNA.

Aspect 32: The synthetic composition of Aspect 27, wherein the first guide RNA or the second guide RNA is capable of forming a complex with the Cas endonuclease encoded by the gene.

Aspect 33: The synthetic composition of Aspect 27, wherein the first guide RNA and the second guide RNA are capable of forming a complex with the Cas endonuclease encoded by the gene.

Aspect 34: The synthetic composition of Aspect 27, wherein the first guide RNA and the second guide RNA are capable of selectively hybridizing with an identical DNA sequence.

Aspect 35: The synthetic composition of Aspect 27, wherein the first guide RNA and the second guide RNA are capable of selectively hybridizing with non-identical DNA sequences.

Aspect 36: The synthetic composition of Aspect 28, wherein the first target sequence is greater than or equal to 90% identical to the second target sequence, over the full length of the first target sequence.

Aspect 37: The synthetic composition of Aspect 28, wherein the first target sequence is less than 90% identical to the second target sequence, over the full length of the first target sequence.

Aspect 38: The synthetic composition of Aspect 28, wherein the second target sequence is capable of selectively hybridizing with the same guide RNA sequence to which the first target sequence is capable of selectively hybridizing.

Aspect 39: The synthetic composition of Aspect 28, wherein the second target site is not identical to the first target site.

Aspect 40: The synthetic composition of Aspect 28, wherein the second target site is identical to the first target site.

Aspect 41: The synthetic composition of Aspect 27, wherein at least one of said first and second guide RNAs is provided as a ribonucleotide.

Aspect 42: The synthetic composition of Aspect 27, wherein at least one of said first and second guide RNAs is provided as a deoxyribonucleotide.

Aspect 43: The synthetic composition of Aspect 27, wherein the first target sequence comprises a PAM sequence that is capable of being recognized by a Cas endonuclease.

Aspect 44: The synthetic composition of Aspect 27, wherein the first target sequence comprises a PAM sequence that is capable of being recognized by the Cas endonuclease of (b)(i).

Aspect 45: The synthetic composition of Aspect 27, wherein the first target sequence comprises a PAM sequence that is inverted.

Aspect 46: The synthetic composition of Aspect 27, wherein the helper plasmid is a superbinary vector.

Aspect 47: The method of Aspect 28, wherein the superbinary vector is pVIR7, pVIR9, or pVIR10

Aspect 48: The synthetic composition of Aspect 27, wherein the morphogenic factor is BBM, WUS, or a combination of BBM and WUS.

Aspect 49: The synthetic composition of Aspect 27, comprising BBM and WUS.

Aspect 50: The synthetic composition of Aspect 27, wherein the recombinant construct of further comprises a selectable marker gene.

Aspect 51: The synthetic composition of Aspect 50, wherein the selectable marker gene is part of the donor DNA cassette.

Aspect 52: The synthetic composition of Aspect 50, wherein the selectable marker gene is outside of the donor DNA cassette.

Aspect 53: The synthetic composition of Aspect 27, wherein the polynucleotide of interest comprises a gene conferring a trait of interest.

Aspect 54: The synthetic composition of Aspect 27, wherein a trait of interest is modulated in a plant derived or obtained from the plant cell, wherein the trait of interest is selected from the group consisting of: selectable marker resistance, disease resistance, drought tolerance, heat tolerance, cold tolerance, salinity tolerance, metal tolerance, herbicide tolerance, improved water use efficiency, improved nitrogen utilization, improved nitrogen fixation, pest resistance, herbivore resistance, pathogen resistance, yield improvement, health enhancement, vigor improvement, growth improvement, photosynthetic capability improvement, nutrition enhancement, altered protein composition, altered oil composition, increased biomass, increased shoot length, increased root length, improved root architecture, modulation of a metabolite, modulation of the proteome, increased seed weight, altered seed carbohydrate composition, altered seed oil composition, altered seed protein composition, altered seed nutrient composition, improved fertility, improved fecundity, improved environmental tolerance, improved vigor, improved disease resistance, improved disease tolerance, improved tolerance to a heterologous molecule, improved fitness, improved physical characteristic, greater mass, increased production of a biochemical molecule, decreased production of a biochemical molecule, upregulation of a gene, downregulation of a gene, upregulation of a biochemical pathway, downregulation of a biochemical pathway, stimulation of cell reproduction, and suppression of cell reproduction.

Aspect 55: The synthetic composition of Aspect 27, wherein the plant cell is a monocot or a dicot cell, optionally selected from the group consisting of: *Zea mays, Sorghum bicolor, Sorghum vulgare, Triticum aestivum, Medicago sativa, Oryza sativa, Setaria italica, Saccharum* spp., *Helianthus annuus, Glycine max, Nicotiana tabacum, Gossypium barbadense, Gossypium hirsutum, Manihot esculenta, Beta vulgaris, Brassica* spp., and *Arabidposis thaliana*.

Aspect 56: A method for homologous recombination repair of a double-strand break at a first target site sequence in a first polynucleotide, the method comprising providing to the first polynucleotide: (a) a first double-strand-break-inducing agent, (b) optionally, at least one morphogenic factor, and (c) a second polynucleotide sequence, further comprising: (i) a heterologous polynucleotide; (ii) a set of two homology regions flanking the heterologous polynucleotide, wherein one homology region comprises a sequence sharing sufficient homology with the polynucleotide sequence upstream of the first target site in the first polynucleotide and the second homology region comprises a sequence sharing sufficient homology with the polynucleotide sequence downstream of the first target site sequence; and, (iii) a second target site sequence that is recognized and cleaved by a second double-strand-break-inducing agent, wherein the second target site sequence is next to one of the homology regions of (c)(ii) but is not next to the heterologous polynucleotide of (c)(i); wherein the second double-strand-break-inducing agent cleaves the second target site sequence to create a double-strand-break in the second polynucleotide sequence; wherein the first double-strand-break-inducing agent creates a double-strand break at the first target site sequence, and wherein the second polynucleotide sequence promotes homologous recombination repair of the double-strand break at the first target site sequence.

Aspect 57: A method for modifying a genomic target site of a plant cell, the method comprising providing to the plant cell: (a) a first double-strand-break-inducing agent, (b) optionally, at least one morphogenic factor, and (c) a polynucleotide sequence, further comprising: (i) a heterologous polynucleotide; (ii) a set of two homology regions flanking the heterologous polynucleotide, wherein one homology region comprises a sequence sharing sufficient homology with the polynucleotide sequence upstream of the genomic target site and the other homology region comprises a sequence sharing sufficient homology with the polynucleotide sequence downstream of the genomic target site; and, (iii) a second target site sequence that is recognized and cleaved by a second double-strand-break-inducing agent, wherein the second target site sequence is next to one of the homology regions of (c)(ii) but is not next to the heterologous polynucleotide of (c)(i); wherein the second double-strand-break-inducing agent cleaves the second target site sequence to create a double-strand-break in the second polynucleotide sequence; wherein the first double-strand-break-inducing agent creates a double-strand break at the genomic target site, and wherein the polynucleotide sequence of (c) promotes homologous recombination repair of the double-strand break at the first target site sequence.

Aspect 58: A synthetic composition, comprising: (a) a plant cell comprising a first polynucleotide sequence comprising a first target site, (b) a double-strand-break-inducing agent, (c) optionally, at least one morphogenic factor, and (d) a second polynucleotide sequence, further comprising: (i) a heterologous polynucleotide; (ii) a set of two homology regions flanking the heterologous polynucleotide, wherein one homology region comprises a sequence sharing sufficient homology with the polynucleotide sequence upstream of the first target site in the first polynucleotide and the second homology region comprises a sequence sharing sufficient homology with the polynucleotide sequence downstream of the first target site sequence; and, (iii) a second target site sequence that is recognized and cleaved by a second double-strand-break-inducing agent, wherein the second target site sequence is next to one of the homology regions of (c)(ii) but is not next to the heterologous polynucleotide of (c)(i); wherein the second double-strand-break-inducing agent cleaves the second target site sequence to create a double-strand-break in the second polynucleotide sequence; wherein the first double-strand-break-inducing agent creates a double-strand break at the first target site sequence, and wherein the second polynucleotide sequence promotes homologous recombination repair of the double-strand break at the first target site sequence.

Aspect 59: The method of Aspect 56, Aspect 57, or Aspect 58, wherein the first double-strand-break-inducing agent is the same as the second double-strand-break-inducing agent.

Aspect 60: The method of Aspect 56, Aspect 57, or Aspect 58, wherein the first double-strand-break-inducing agent is different than the second double-strand-break-inducing agent.

Aspect 61: The method of Aspect 56, Aspect 57, or Aspect 58, wherein the second target site sequence of (c)(iii) is different than the first target site sequence.

Aspect 62: The method of Aspect 56, Aspect 57, or Aspect 58, wherein the second target site sequence of (c)(iii) is the same as the first target site sequence.

Aspect 63: The method of Aspect 56, Aspect 57, or Aspect 58, wherein the second polynucleotide comprises two target site sequences of (c)(ii), each of which is next to a different one of the homology regions of (c)(i) but neither of which is next to the heterologous polynucleotide of (c)(i).

Aspect 64: The method of Aspect 56, Aspect 57, or Aspect 58, wherein the two target site sequences of (c)(ii) are non-identical.

Aspect 65: The method of Aspect 63, wherein the two target site sequences are identical to each other but non-identical to the first target site sequence of the first polynucleotide.

Aspect 66: The method of Aspect 63, wherein the two target site sequences are identical to each other and to the first target site sequence of the first polynucleotide.

Aspect 67: The method of Aspect 56, wherein first polynucleotide is in a cell.

Aspect 68: The method of Aspect 67, wherein the cell is selected from the group consisting of: plant, animal, bacterium, archaebacterium, protist, and fungus.

Aspect 69: The method of Aspect 68, wherein the plant is selected from the group consisting of a monocot plant or a dicot plant. In some embodiments, the plant cell is obtained or derived from a plant selected from the group consisting of: a monocot, a dicot, corn (*Zea mays*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), wheat (*Triticum* species, for example *Triticum aestivum, Triticum monococcum*), sugarcane (*Saccharum* spp.), oats (*Avena*), barley (*Hordeum*), switchgrass (*Panicum virgatum*), pineapple (*Ananas comosus*), banana (*Musa* spp.), palm, ornamentals, turfgrasses, an other grasses, soybean (*Glycine max*), Brassica species (for example but not limited to: oilseed rape or Canola) (*Brassica napus, B. campestris, Brassica rapa, Brassica. juncea*), alfalfa (*Medicago sativa*),), tobacco (*Nicotiana tabacum*), Arabidopsis (*Arabidopsis thaliana*), sunflower (*Helianthus annuus*), cotton (*Gossypium arboreum, Gossypium barbadense*), peanut (*Arachis hypogaea*), tomato (*Solanum lycopersicum*), potato (*Solanum tuberosum*), safflower (*Carthamus tinctorius*), sweet potato (*Ipomoea batatus*), cassava (*Manihot esculenta*), coffee (*Coffea* spp.), coconut (*Cocos nucifera*), citrus trees (Citrus spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), vegetables, ornamentals, conifers, vegetables (for example, but not limited to: tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*)), and ornamentals (such as, but not limited to: azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum)).

Aspect 71: The method of Aspect 56, wherein first polynucleotide is in a protoplast.

Aspect 72: The method of Aspect 56, Aspect 57, or Aspect 58, wherein any or all of the components are provided as DNA.

Aspect 73: The method of Aspect 56, Aspect 57, or Aspect 58, wherein the double-strand-break-inducing agent is provided as a polynucleotide on a recombinant construct that is transcribed in the cell.

Aspect 74: The method of Aspect 56, Aspect 57, or Aspect 58, Aspect 73, further comprising providing a helper plasmid.

Aspect 75: The method of Aspect 56, Aspect 57, or Aspect 58, wherein the DSB agent is provided as a protein.

Aspect 76: The method of Aspect 56, Aspect 57, or Aspect 58, wherein the DSB agent is a ribonucleoprotein complex.

Aspect 77: The method of Aspect 56, Aspect 57, or Aspect 58, wherein the double-strand-break-inducing agent is a Cas endonuclease, wherein the method further comprises providing a first guide RNA to the first polynucleotide, wherein the first guide RNA selectively hybridizes with a polynucleotide sequence at or near the first target site, and wherein the first guide RNA and the Cas endonuclease form a complex that nicks or cleaves the first target site.

Aspect 78: The method of Aspect 56, Aspect 57, or Aspect 58, further comprising providing a selectable marker or selectable marker gene.

Aspect 79: The method of Aspect 56, Aspect 57, or Aspect 58, wherein the second polynucleotide further comprises a selectable marker gene next to the second target site sequence but not next to either of the two homology regions.
    wherein the selectable marker gene is between a TSS and one of the homology regions Aspect 80: The method of Aspect 56, Aspect 57, or Aspect 58, wherein the second polynucleotide further comprises a selectable marker gene, wherein the selectable marker gene is between a homology region and the heterologous polynucleotide Aspect 81: The method of Aspect 56, Aspect 57, or Aspect 58, wherein the heterologous polynucleotide of (c) is a donor DNA molecule that is incorporated into the target site.

Aspect 82: The method of Aspect 56, Aspect 57, or Aspect 58, wherein the heterologous polynucleotide of (c) is a polynucleotide modification template that comprises at least one nucleotide difference as compared to the target site sequence.

Aspect 83: The method of Aspect 82, wherein the nucleotide difference selected from the group consisting of: insertion of at least one nucleotide, deletion of at least one nucleotide, substitution or replacement of at least one nucleotide, chemical modification of at least one nucleotide, and any combination of the preceding.

Aspect 84: The method of Aspect 56, Aspect 57, or Aspect 58, further comprising: (d) identifying at least one nucleotide difference in the first polynucleotide from the homologous recombination repair of the double-strand-break at the first target site sequence, wherein the at least one nucleotide difference is selected from the group consisting of: the insertion of at least one nucleotide, the substitution of at least one nucleotide, the deletion of at least one nucleotide, the chemical modification of at least one nucleotide, and any combination of the preceding.

While the invention has been particularly shown and described with reference to a preferred embodiment and various alternate embodiments, it will be understood by persons skilled in the relevant art that various changes in form and details can be made therein without departing from the spirit and scope of the invention. For instance, while the particular examples below may illustrate the methods and embodiments described herein using a specific plant, the principles in these examples may be applied to any plant. Therefore, it will be appreciated that the scope of this invention is encompassed by the embodiments of the inventions recited herein and in the specification rather than the specific examples that are exemplified below. All cited patents, applications, and publications referred to in this application are herein incorporated by reference in their entirety, for all purposes, to the same extent as if each were individually and specifically incorporated by reference.

EXAMPLES

The following are examples of specific embodiments of some aspects of the invention. The examples are offered for illustrative purposes only, and are not intended to limit the scope of the invention in any way. Efforts have been made to ensure accuracy with respect to numbers used (e.g., amounts, temperatures, etc.), but some experimental error and deviation should, of course, be allowed for.

Improved HDR-facilitated gene insertion was facilitated by technological advancements in *Agrobacterium*-mediated component delivery. First, vectors were constructed comprising morphogenic factors driven by tissue specific promoters (PLTP:ODP2 and Axig:WUS). Use of these promoters resulted in rapid division of infected cells, leading to stronger embryogenic response resulting in plant regeneration with higher frequency. Second, use of highly virulent strains complemented with a helper plasmid (such as pVIR9) resulted in delivery of higher T-DNA copy number.

The *Agrobacterium*-mediated methods disclosed herein resulted in the increased frequency of HDR-facilitated gene insertion Quality Events (QE) versus particle bombardment-mediated delivery and *Agrobacterium*-mediated delivery without the morphogenic factors or helper plasmids, which was reproducible across multiple genotypes, and did not require a selectable marker as part of the donor DNA molecule.

Example 1: Vector Construction

Maize Vectors for SDN3

The T-DNA vectors used in these experiments are Vectors 1-4, depicted in FIGS. 5-8, and given as SEQID NOs:46-49, respectively.

Each vector comprised morphogenic factors (WUS and ODP2 under Axig and PLTP promoters, respectively), cas9 driven by the Ubiquitin promoter, gRNA for the Target Site (TS) sequence (SEQID NO:30) operably linked to the maize U6 polymerase III promoter SEQID NO:17, and two selectable marker genes—herbicide resistant ALS (HRA SEQID NO:21) and neomycin phosphotransferase II (NptII, DNA SEQID NO:24) under the native maize ALS and Ubiquitin promoters, respectively (SEQID NO:20 and SEQID NO:8). The nptII gene driven by the Ubiquitin promoter was flanked with DNA fragments homologous to sequence at the TS region (HR arms SEQID NO:32 and SEQID NO:33 for Genotype A; HR arms SEQID NO:34 and SEQID NO:35 for Genotype B; HR arms SEQID NO:36 and SEQID NO:37 for Genotype C). The experiment was conducted using constructs with and without TS sequences with a PAM flanking both HR arms (SEQID NO:31); the presence of TS targets with PAM sequences allowed cleavage-mediated release of the donor DNA (SEQID NOs:38-41 for Vectors 1-4, respectively) from the T-DNA molecule. The lengths of the homology region "arms" (HR1 and HR2) in each vector ranged from 411 to 417 nucleotides in length.

The cas9 gene from *Streptococcus pyogenes* M1 GAS (SF370) (Exon 1 SEQID NO:12; Exon 2 SEQID NO:14) was optimized per standard techniques known in the art, and the potato ST-LS1 intron (SEQID NO:13) was introduced in order to eliminate its expression in *E. coli* and *Agrobacterium*. To facilitate nuclear localization of the Cas9 protein in maize cells, Simian virus 40 (SV40) monopartite amino terminal nuclear localization signal (DNA SEQID NO:11; PRT SEQID NO:43) and *Agrobacterium tumefaciens* bipartite VirD2 T-DNA border endonuclease carboxyl terminal nuclear localization signal (DNA SEQID NO:15; PRT SEQID NO:44) were incorporated at the amino and carboxyl-termini of the Cas9 open reading frame, respectively. The maize-optimized cas9 gene was operably linked to a constitutive or regulated promoter by standard molecular biological techniques. An example of the maize-optimized Cas9 expression cassette is given as SEQID NO:42.

*Agrobacteria* with a helper plasmid (such as pVIR9) can significantly improve transient protein expression in plants, such as but not limited to corn, for example as described in WO2017078836A1 (published 11 May 2017).

Figure 4A:
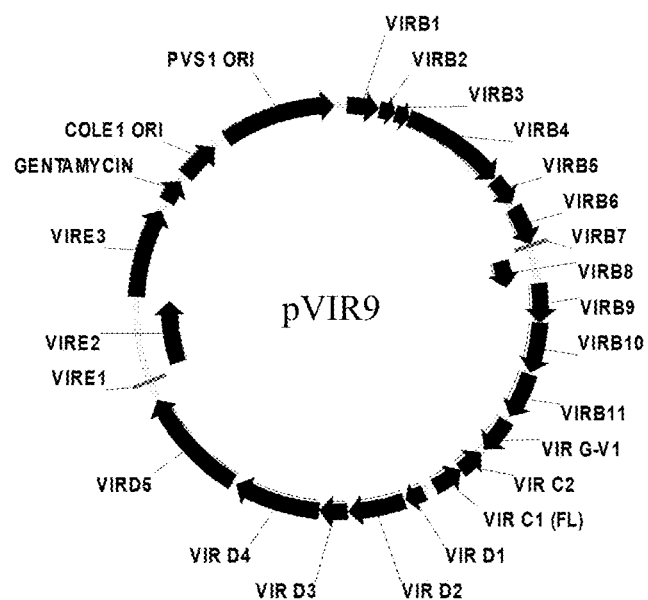
FIG. 4A depicts the superbinary vector helper plasmid comprising pVIR9 (SEQID NO:45).
Figure 4B:
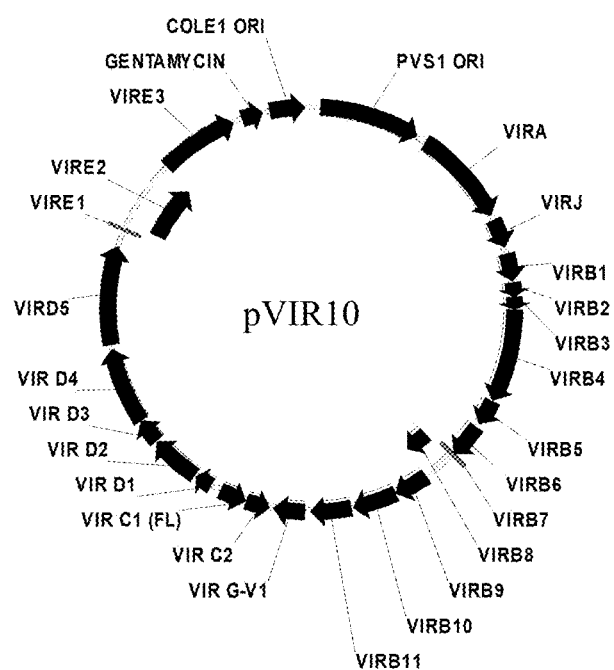
FIG. 4B depicts another example of a superbinary vector helper plasmid, comprising pVIR10.

Briefly, SEQID NO: 45 (FIG. 4) comprising: a smaller, more stable origin of replication (pVS1) instead of a larger, less stable origin of replication (RK2); a frameshift-repaired virC1-2 operon; the complete virD operon (i.e., virD1-D5) along with the virE1-3 and virG genes; and lacking truncated tra and trb operons or flanking genes as well as the 2.7 kbp pBR322 fragment found in pSB1 comprising the origin of replication, a beta lactamase coding sequence, and unstable 18 bp poly-G flanked lambda COS sites; was incorporated into the *Agrobacterium tumefaciens* strain harboring the vector comprising the Cas9/gRNA/HR expression cassette, for transformation into the target cell.

Co-transformation with morphogenic factors (also referred to as "morphogenic genes", or "developmental genes", or "cell proliferation factors"), such as but not limited to "babyboom" (BBM), "ovule development protein" (ODP), and/or "Wuschel" (WUS) (as described in US20110165679A1, published 7 Jul. 2011; WO2005075655A2, published 18 Aug. 2005) can stimulate embryogenesis, and in addition, can enhance targeted polynucleotide modification at a double-strand break site.

Briefly, SEQID NOs: 6 (ODP2, a.k.a. BBM) and 2 (WUS) were incorporated into the transformation vector comprising the Cas9/gRNA/HR expression cassette, for transformation into the target cell, as shown in FIG. 1.

Maize Vectors for SDN2

The T-DNA vectors used in the Cas9 maize SDN2 experiments were Vectors 5-8, depicted in FIGS. 10A-10D and 11-14, and given as SEQID NOs: 50-53, respectively. The lengths of the homology region "arms" (HR1 and HR2) in each vector ranged from 82 to 411 nucleotides in length.

Soybean Vectors for SDN2 and SDN3

The T-DNA vectors used in the Cas9 soybean experiments were Vectors 9-17, depicted in FIGS. 18A-18I, and given as SEQID NOs: 54-62, respectively. The lengths of the homology region "arms" (HR1 and HR2) in each vector ranged from 591 to 980 nucleotides in length.

Canola Vectors for HDR

The T-DNA vectors used in the Cas9 canola HDR experiments were Vectors 25-29; depicted in FIGS. 39A, 39B, 43A, 43B and 47; and given as SEQID NOs: 65-69, respectively.

Example 2: Cell Transformation

Methods of *Agrobacterium*-mediated cell transformation are known in the art (see, for example, U.S. Pat. Nos. 5,563,055 and 5,981,840). In one example, the methods described in US20170121722A1 (published 4 May 2017) were used.

Preparation of *Agrobacterium* Master Plate

*Agrobacterium tumefaciens* harboring a binary donor vector was streaked out from a −80° C. frozen aliquot onto solid 12V medium and cultured at 28° C. in the dark for 2-3 days to make a master plate.

Growing *Agrobacterium* on Solid Medium

Single or multiple colonies of *Agrobacterium* were picked from the master plate and streaked onto a second plate containing 810I medium and incubated at 28° C. in the dark for 1-2 days. *Agrobacterium* infection medium (700 medium; 5 ml) and 100 mM 3'-5'-Dimethoxy-4'-hydroxy-acetophenone (acetosyringone; 5 µL) were added to a 14 mL conical tube in a hood. About 3 full loops of *Agrobacterium* from the second plate were suspended in the tube and the tube was then vortexed to make an even suspension. Suspension (1 ml) was transferred to a spectrophotometer tube and the optical density (550 nm) of the suspension was adjusted to a reading of about 0.35-2.0. The *Agrobacterium* concentration was approximately 0.5 to 2.0×10$^9$ cfu/mL. The final *Agrobacterium* suspension was aliquoted into 2 mL microcentrifuge tubes, each containing about 1 mL of the suspension. The suspensions were then used as soon as possible.

Growing *Agrobacterium* on Liquid Medium

Alternatively, *Agrobacterium* can be prepared for transformation by growing in liquid medium. One day before infection, a 125 ml flask was prepared with 30 ml of 557A medium (10.5 g/l potassium phosphate dibasic, 4.5 g/l potassium phosphate monobasic anhydrous, 1 g/l ammonium sulfate, 0.5 g/l sodium citrate dehydrate, 10 g/l sucrose, 1 mM magnesium sulfate) and 30 µL spectinomycin (50 mg/mL) and 30 µL acetosyringone (20 mg/mL). A half loopful of *Agrobacterium* from a second plate was suspended into the flasks and placed on an orbital shaker set at 200 rpm and incubated at the 28° C. overnight. The *Agrobacterium* culture was centrifuged at 5000 rpm for 10 min.

The supernatant was removed and the *Agrobacterium* infection medium with acetosyringone solution was added. The bacteria were resuspended by vortex and the optical density (550 nm) of *Agrobacterium* suspension was adjusted to a reading of about 0.35 to 2.0.

Maize Transformation

Ears of a maize (*Zea mays* L.) cultivar were surface-sterilized for 15-20 min in 20% (v/v) bleach (5.25% sodium hypochlorite) plus 1 drop of Tween 20 followed by 3 washes in sterile water. Immature embryos (IEs) were isolated from ears and were placed in 2 ml of the *Agrobacterium* infection medium with acetosyringone solution. The optimal size of the embryos varies based on the inbred, but for transformation with WUS2 and ODP2 a wide size range of immature embryo sizes could be used. The solution was drawn off and 1 ml of *Agrobacterium* suspension was added to the embryos and the tube vortexed for 5-10 sec. The microfuge tube was allowed to stand for 5 min in the hood. The suspension of *Agrobacterium* and embryos were poured onto 7101 co-cultivation medium. Any embryos left in the tube were transferred to the plate using a sterile spatula. The *Agrobacterium* suspension was drawn off and the embryos placed axis side down on the media. The plate was sealed with Parafilm M® film (moisture resistant flexible plastic, available at Bemis Company, Inc., 1 Neenah Center 4$^{th}$ floor, PO Box 669, Neenah, WI 54957) and incubated in the dark at 21° C. for 1-3 days of co-cultivation.

Embryos were transferred to resting medium (605T medium) without selection. Three to seven days later, they were transferred to either a selection medium for event selection, or to maturation medium (289Q medium) supplemented with a selective agent.

It is contemplated that other bacterium-mediated transformation methods can be used, for example, with *Ochrobactrum*.

Soy Transformation

Standard protocols for particle bombardment (Finer and McMullen, 1991, In Vitro Cell Dev. Biol.—Plant 27:175-182), *Agrobacterium*-mediated transformation (Jia et al., 2015, Int J. Mol. Sci. 16:18552-18543; US20170121722 incorporated herein by reference in its entirety), or *Ochrobactrum*-mediated transformation (US20180216123 incorporated herein by reference in its entirety) for soybean can be used with the methods of the disclosure.

Soybean transformation was done essentially as described by Paz et al. ((2006) Plant Cell Rep 25:206-213) and U.S. Pat. No. 7,473,822. Mature seed from soybean lines were surface-sterilized for 16 hrs using chlorine gas, produced by mixing 3.5 mL of 12 N HCl with 100 mL of commercial bleach (5.25% sodium hypochloride), as described by Di et al. ((1996) Plant Cell Rep 15:746-750). Disinfected seeds were soaked in sterile distilled water at room temperature for 16 hrs (100 seeds in a 25×100 mm petri dish).

A volume of 10 mL of *Ochrobactrum haywardense* H1 NRRL Deposit B-67078 further containing vector PHP70365 (SEQID NO: 106) suspension at OD600=0.5 in infection medium containing 300 µM acetosyringone was added to the soaked seeds. The seeds were then split by cutting longitudinally along the hilum to separate the cotyledons, and the seed coats, primary shoots, and embryonic axes were removed in *Ochrobactrum haywardense* H1 NRRL Deposit B-67078 suspension, thereby generating half-seed explants. The half-seed explants were placed flat side down in a deep plate with 4 mL fresh *Ochrobactrum*/ infection media with no overlapping of cotyledons. The plates were sealed with parafilm ("Parafilm M" VWR Cat #52858), then sonicated (Sonicator-VWR model 50T) for 30 seconds. After sonication, half-seed explants were transferred to a single layer of autoclaved sterile filter paper (VWR #415/Catalog #28320-020) onto co-cultivation solid medium (18-22 explants per plate; flat side down). The plates were sealed with Micropore tape (Catalog #1530-0, 3M, St. Paul, MN)) and incubated under dim light (5-10 $\mu E/m^2/s$, cool white fluorescent lamps) for 16 hrs at 21° C. for 5 days.

Canola Transformation

*Agrobacterium*-mediated transformation was performed as described in (De Block, M., et al. (1989). "Transformation of *Brassica napus* and *Brassica oleracea* Using *Agrobacterium tumefaciens* and the Expression of the bar and neo Genes in the Transgenic Plants." Plant Physiology 91(2): 694-701).

Example 3: Plant Regeneration

Maize Regeneration

Sixteen days later, embryos with healthy somatic embryos generated in Example 2 were moved onto a regeneration medium.

In one example, embryos were treated with *Agrobacterium* and one day later selected embryos were moved onto 605T medium (no selection for the first week), 605T medium with 0.1 mg/l ethametsulfuron with AA (early selection with AA) or 605T medium with 0.1 mg/l ethametsulfuron (early selection with no AA), respectively. For the next transfer, selected embryos were moved onto their respective maturation media. For the final transfer to rooting medium, selected plantlets of individual events were moved. For this experiment, the total elapsed time from *Agrobacterium* infection to the greenhouse was 48 days.

In another example, embryos were treated with *Agrobacterium* in liquid for 5 minutes and then co-cultured for one day on 7101 medium. At this point, selected embryos were moved onto 605T medium, 605T medium with 0.1 mg/l ethametsulfuron with AA or or 605T medium with 0.1 mg/l ethametsulfuron, respectively. Twelve days later, the embryos on 605T were split onto either 289Q medium with 0.1 mg/l imazapyr or onto 289Q medium with 0.5 mg/l imazapyr. The embryos from both the 605T medium with 0.1 mg/l ethametsulfuron with AA and 605T medium with 0.1 mg/l ethametsulfuron were moved onto 289Q (no further selection). After maturation, healthy plantlets (events) were transferred to rooting medium 13158H, with selected events being moved from the above maturation treatments, respectively.

Soy Regeneration

Methods were carried out according to those disclosed in WO2017040343A1 (published 9 Mar. 2017). After co-cultivation, the half-seed explants were washed in liquid shoot induction (SI) medium once then the explants were cultured on shoot induction medium solidified with 0.7% agar in the absence of selection. The base of the explant (i.e., the part of the explant from where the embryonic axis was removed) was embedded in the medium, facing upwards. Shoot induction was carried out in a Percival Biological Incubator at 24° C. with a photoperiod of 18 hrs and a light intensity of 130-160 $\mu E/m^2/s$. After 14 days, the explants were transferred to fresh shoot induction medium containing 3 mg/L bialaphos. The half seed explants were transferred to fresh medium every two weeks. After four weeks of culture on shoot induction medium, explants were transferred to shoot elongation (SE) medium containing 5 mg/L bialaphos (Table 10). Six to ten weeks later, elongated shoots (>1-2 cm) were isolated and transferred to rooting medium (Table 10) containing 1 mg/L bialaphos.

Canola Regeneration

Canola plant regeneration was performed as described in (De Block, M., et al. (1989). "Transformation of *Brassica napus* and *Brassica oleracea* Using *Agrobacterium tumefaciens* and the Expression of the bar and neo Genes in the Transgenic Plants." Plant Physiology 91(2): 694-701).

Example 4: Analysis of HDR Frequency

Maize SDN3

Figures 2, 2A, 2B:
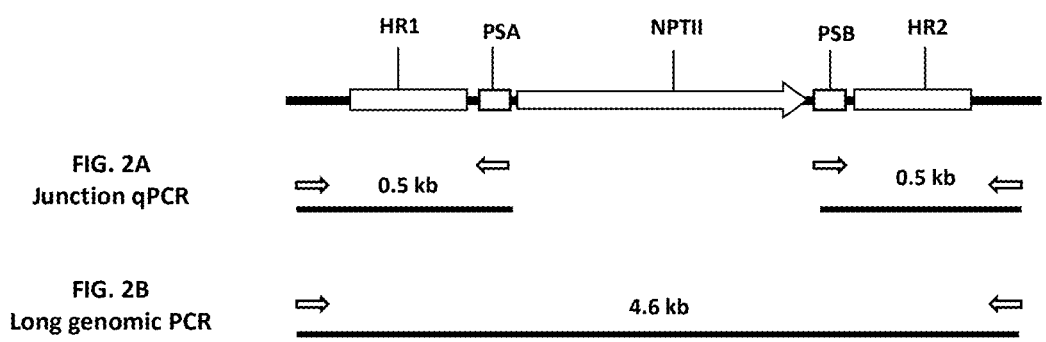

T0 plants were regenerated using the nptII gene as selectable marker and analyzed by junction qPCR for targeted gene insertion. Double (2×) HDR positive events (i.e., recombination happened on both ends of the double strand break as demonstrated from junction qPCR results) were further analyzed by long PCR to evaluate the size and integrity of the insertion (see FIG. 2 for details).

*Agrobacterium*-mediated transformation and plant regeneration were performed as described in Examples 2 and 3. Several experiments were conducted to evaluate feasibility of these improved methods and to compare the potential effects of variable parameters on frequency of HDR events: i) strains complemented with helper plasmid pVIR9 (see Example 2); and ii) presence and absence of TS sequences with PAM flanking HR arms of the donor DNA. All experiments comprised morphogenic factors. Results are summarized in Table 1.

TABLE 1

Frequencies of HDR-facilitated targeted gene insertion events. Frequencies are calculated based on the total number of plants analyzed in each experiment. Two different constructs were tested: one with target site sequences flanking the donor DNA and one without target site sequences flanking the donor DNA.

| Genotype, Agro strain, and vector design | Embryos transformed | Number of T0s sampled (Txn eff.) | Number of 2xHDR positive events by junction qPCR (%) | Number of long (genomic) PCR positive events (%) |
| --- | --- | --- | --- | --- |
| Genotype A, AGL1, donor DNA without | 865 | 295 (34%) | 6 (2.0%) | 4 (1.3%) |

TABLE 1-continued

Frequencies of HDR-facilitated targeted gene insertion events. Frequencies are calculated based on the total number of plants analyzed in each experiment. Two different constructs were tested: one with target site sequences flanking the donor DNA and one without target site sequences flanking the donor DNA.

| Genotype, Agro strain, and vector design | Embryos transformed | Number of T0s sampled (Txn eff.) | Number of 2xHDR positive events by junction qPCR (%) | Number of long (genomic) PCR positive events (%) |
|---|---|---|---|---|
| TSs, nptII as selectable marker | | | | |
| Genotype A, AGL1, donor DNA w/TSs, nptII as selectable marker | 866 | 159 (18%) | 19 (11.9%) | 12 (7.5%) |
| Genotype A, LBA4404, donor DNA without TSs, nptII as selectable marker | 889 | 343 (39%) | 12 (3.5%) | 6 (1.7%) |
| Genotype A, LBA4404, donor DNA w/TSs, nptII as selectable marker | 865 | 425 (49%) | 39 (9.2%) | 26 (6.1%) |

No statistical difference was detected between the two *Agrobacterium* strains tested. However, T-DNA with TS target sequences with PAM flanking HR arms yielded 3-5-fold higher number of double (2×) HDR positive events, compared to T-DNA where HR arms were not flanked with TS sequences. To validate these results, the experiment was repeated using one *Agrobacterium* strain (LBA4404 with helper pVIR9 plasmid) and only T-DNA constructs comprising donor DNA flanked with TS sequences with PAM. We also compared the frequency of quality insertion event recovery (based on long PCR results) in plants regenerated on the media with different selective agents—G418 (nptII as selectable marker gene, the trait gene flanked with HR arms) or imazapyr (HRA as selectable marker gene outside donor DNA). For that reason, after infection and resting, half of the embryos were moved to the media with G418 and the second half of the embryos was transferred to the media with imazapyr.

Similar results were observed in comparison to the first experiment described above using nptII as selectable marker. Moreover, no significant difference in frequencies of long-PCR positive insertion events was detected between the parts of the experiment when two different selectable marker genes—Ubi::nptII as a part of the donor DNA and ALS pr::HIRA outside the donor DNA, were used. Results are summarized in Table 2.

TABLE 2

Frequencies of HDR-facilitated targeted gene insertion events in the experiment when two different selectable marker genes, one as a part of donor DNA and second - outside donor DNA. Frequencies are calculated based on the total number of plants analyzed in each experiment.

| Genotype, Agro strain and vector design | Embryos transformed | Number of T0s sampled (Txn eff.) | Number of 2xHDR positive events by junction qPCR (%) | Number of long (genomic) PCR positive events (%) |
|---|---|---|---|---|
| Genotype A, LBA4404, donor DNA w/TSs, nptII as selectable marker | 4091 | 1565 (38%) | 143 (9.1%) | 89 (5.7%) |
| Genotype A, LBA4404, donor DNA w/TSs, HRA as selectable marker | 1975 | 762 (38%) | 64 (8.4%) | 37 (4.8%) |

Figure 3:
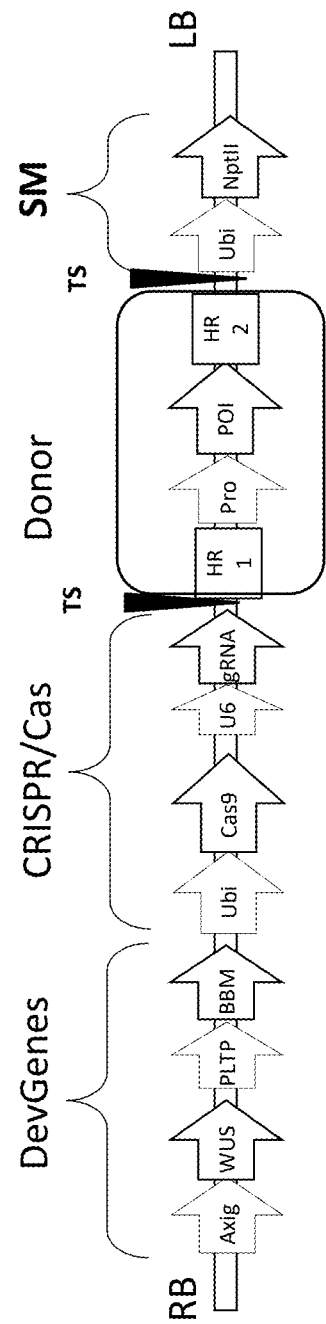
FIG. 3 is a schematic illustration of the T-DNA molecules used in Agro-SDN3 experiments. Donor DNA with homology arms flanked with TS sequences with PAM; the selectable marker cassette is outside of the donor DNA cassette; "POI" stands for "polynucleotide of interest", which in some examples encoded a trait of interest, for example a trait of agronomic importance or interest.

To further validate the data, experiment was repeated using two other elite genotypes (B and C. A slightly different T-DNA vector was used in these experiments: a trait gene flanked with HR arms and TS sequences with PAM was followed by Ubi::nptII as selectable marker gene (FIG. 3). Results of the experiments are summarized in Table 3. Previously generated results for Genotype A are shown for comparison.

TABLE 3

Frequencies of HDR-facilitated targeted gene insertion events in three different elite genotypes. Frequencies are calculated based on the total number of plants analyzed in each experiment.

| Genotype, Agro strain and vector design | Embryos transformed | Number of T0s sampled (Txn eff.) | Number of 2xHDR positive events by junction qPCR (%) | Number of long (genomic) PCR positive events (%) |
|---|---|---|---|---|
| Genotype A, donor DNA w/TSs, HRA as selectable marker (outside donor DNA) | 1975 | 762 (38%) | 64 (8.4%) | 37 (4.8%) |
| Genotype B, Donor - Trait Gene w/TSs, nptII as selectable marker (outside donor DNA) | 2000 | 1406 (70%) | 116 (8.2%) | 63 (5.8%) |
| Genotype C, Donor - Trait Gene w/TSs, nptII as selectable marker (outside donor DNA) | 1000 | 763 (76%) | 31 (4.1%) | 16 (2.1%) |

Further experiments were carried out using *Agrobacterium*-mediated deliver of plasmids comprising the HDR cassette flanked by target sequences, for four different treatments, in maize Genotype A. Treatment 1 further comprised morphogenic factors and a helper plasmid. Treatment 2 further comprised morphogenic factors. Treatment 3 further comprised a helper plasmid. Treatment 4 comprised no morphogenic factors nor a helper plasmid. Digital droplet PCR (DD-PCR) of two biological reps (2 independent transfections) and three technical reps (three DD PCR reactions) was performed on embryos collected seven days after transfection. Results are shown in Table 4.

including the use of morphogenic factors (such as ODP2, WUS) and a helper plasmid (such as pVIR9) significantly increased frequencies of HDR-positive events when compared to standard *Agrobacterium*-mediated transformation system, and iii) no significant differences in frequencies of putative quality integration events (identified by long genomic PCR) were observed in experiments where selectable marker gene was part of the donor DNA or outside. Other types of genome modifications, such as targeted nucleotide editing and gene replacement (swap), will also benefit from this approach.

TABLE 4

Frequencies of HDR-facilitated targeted SDN3 polynucleotide modification edits at a target site in maize, with and without presence of a developmental gene, a helper plasmid, or both.

| Treatment | Mut Freq (AVG of technical reps) | Endogenous gene copy # per microliter (AVG of technical reps) | # genome equivalents per microliter based on endogenous gene copy # | HR1 copy number per microliter (AVG of technical reps) | Frequency of HDR (HR1) per total # of genomes | Frequency of HDR per # of infected genomes (normalized by mutation frequency) |
|---|---|---|---|---|---|---|
| 1 (+DevGenes, +pVIR9) | 4.19% | 835.43 | 417.50 | 3.89 | 0.93% | 22.2% |
| 2 (+DevGenes, −pVIR9) | 0.51% | 722.03 | 361.00 | 0.19 | 0.05% | 9.9% |
| 3 (−DevGenes, +pVIR9) | 0.63% | 971.57 | 486.00 | 0.43 | 0.09% | 14.3% |
| 4 (−DevGenes, −pVIR9)* | 0.03% | 536.10 | 268.00 | 0.03 | 0.01% | |
| HDR-negative control | 0.01% | 1596.18 | | 0.0 | | |

*Numbers generated without pVIR9 helper plasmid and developmental gene(s) are very low and not significantly different from negative control.

These data demonstrate that in addition to improved HDR frequencies with vectors comprising target site sequences flanking the donor/template cassette, HDR frequencies are further increased in cells that are co-transformed with one or more developmental gene(s) (morphogenic factor(s)), a helper plasmid, or both.

This example demonstrated that i) flanking donor DNA cassette with target sites resulting in releasing the donor DNA from the T-DNA molecule increases frequency of targeted insertion events by 3-5-fold, ii) technological advances in *Agrobacterium*-mediated delivery process, Maize SDN2

*Agrobacterium*-mediated transformation of maize plants (of Genotype B) for SDN2 target site modification at a selected target site was carried out and T0 plants analyzed for presence of edits by qPCR, and for the type of edits by NGS (1, 2, 4, or 3 of the nucleotide edits present in the polynucleotide modification template as compared to the native sequence of the target site in the genome of the plant). As shown in Table 5, the majority of edited reads all contained all four nucleotide edits at the target site. The frequency of successful SDN2 may correlate with the length of the polynucleotide modification template.

TABLE 5

Frequencies of HDR-facilitated targeted SDN2 polynucleotide
modification edits at a target site in maize.
Frequencies are calculated based on the total number of plants
analyzed in each experiment. Three different constructs were tested,
as depicted in FIGS. 10A-C.

| Vector | Template | # T0 plants analyzed | EDITS by qPCR | 4 nt EDITS by NGS | 3 nt EDIT by NGS | 1 nt EDIT by NGS |
|---|---|---|---|---|---|---|
| 5 | 200 nt | 752 | 33 (4.4%) | 15 (1.99%) | 3 | 0 |
| 6 | 500 nt | 752 | 25 (3.3%) | 16 (2.13%) | 2 | 0 |
| 8 | 828 nt | 752 | 36 (4.8%) | 23 (3.06%) | 3 | 0 |

Soybean SDN3

*Ochrobacterium* and *Agrobacterium*-mediated transformation and plant regeneration were performed as described in Examples 2 and 3. Several rapid testing experiments were conducted to evaluate feasibility of these improved SDN3 methods in soybean. Soybean embryonic axis infected with *Ochrobacterium* containing SDN3 donor in transformation vectors Vector 9 (FIG. 18A and FIG. 28A) and Vector 10 (FIG. 18B and FIG. 29A) were sampled after 7 days for DNA extraction. Digital droplet PCR (ddPCR) for HR2 junction revealed positive signal for HDR while no HDR signal was detected from control vector (FIGS. 28B-C and 29B-C, respectively).

T0 soybean plants transgenic to vector Vector 12 (FIG. 31) were regenerated using the Spec gene as selectable marker and analyzed by junction qPCR for targeted SDN3 insertion. 2xHDR positive events were further analyzed by sequencing to evaluate the size and integrity of the insertion. Table 6 shows the results.

TABLE 6

Frequencies of HDR-facilitated targeted SDN3 polynucleotide
modification edits at a target site in soy.
Frequencies are calculated based on the total number of plants
analyzed in each experiment.

| | Plants analyzed | 2X HDR | Frequency |
|---|---|---|---|
| Batch 1 | 222 | 7 | 3.2% |
| Batch 2 | 244 | 5 | 2% |
| Total | 466 | 12 | 2.6% |

Soybean leaf explants from seedlings of two different genotypes were infected and co-cultivated for 3 days with *Agrobacterium* containing SDN3 donor in transformation vectors Vector 14 (FIG. 18F, FIG. 24) and Vector 15 (FIG. 18G, FIG. 25). Leaf samples were sampled after 7 days for DNA extraction. Digital droplet PCR (ddPCR) for HR2 junction revealed positive signal for HDR from both vectors (FIG. 49 for Vector 14; FIG. 50 for Vector 15).

Soybean SDN2

T0 soybean plants transgenic to vector Vector 13 (FIG. 18E, FIG. 30A) were regenerated using the Spec gene as selectable marker and analyzed by junction qPCR for targeted SDN2 insertion. 2xHDR positive events were further analyzed by sequencing to evaluate the size and integrity of the insertion. Of 1358 plants analyzed, 8 demonstrated editing, for a frequency of 0.6%. FIGS. 30C and 30D show sequence verification of the edits. Results are shown in Table 7.

TABLE 7

Frequencies of HDR-facilitated targeted SDN2 polynucleotide
modification edits at a target site in soy.
Frequencies are calculated based on the total
number of plants analyzed in each experiment.

| Plants analyzed | Edited | Frequency |
|---|---|---|
| 1358 | 8 | 0.6% |

Canola HDR

Canola inter-nodal segments infected with *Agrobacterium* containing SDN3 donor in transformation vectors depicted in FIGS. 39A and 39B, and given as Vector 25 (FIG. 40; SEQID NO:65) and Vector 26 (FIG. 41; SEQID NO:66), respectively, were incubated at 21° C. for 3 days. Samples were collected after 10 days of infection for DNA extraction. Digital droplet PCR (ddPCR) for HR2 junction revealed positive signal for HDR (FIG. 42). Both these vectors contained selection marker (Spcn) within cut site as template.

Canola transformation using *Agrobacterium* containing SDN3 donor in transformation vectors depicted in FIG. 43A, and given as Vector 27 (FIG. 44; SEQID NO:67) and Vector 28 (FIG. 45; SEQID NO:68) were incubated at 21° C. or 26° C. for 3 days. Digital droplet PCR (ddPCR) for HR2 junction revealed positive signal for HDR (FIG. 46). A higher signal was detected at 26° C.

T0 canola shoots transgenic to vector Vector 28 (FIGS. 43B and 45; SEQID NO:68) and Vector 29 (FIGS. 47 and 48; SEQID NO:69) were regenerated using the Spec gene as selectable marker. Vector 29 comprised Cas9 driven by heat shock-inducible promoter, which was induced ~2 weeks after *Agrobacterium* infection. The regenerated shoots were analyzed by junction qPCR for targeted SDN3 insertion. 2xHDR positive events were further analyzed and confirmed by sequencing to evaluate the size and integrity of the insertion. Table 8 shows the results.

TABLE 8

Frequencies of HDR-facilitated targeted SDN3 polynucleotide
modification edits at a target site in canola.
Frequencies are calculated based on the total number of shoots
analyzed in each experiment.

| | Shoots analyzed | 2X HDR | Frequency |
|---|---|---|---|
| Vector 28 | 385 | 4 | 1% |
| Vector 29 | 244 | 5 | 1.3% |

These examples demonstrated robust *Ochrobacterium*- and *Agrobacterium*-mediated SDN2 and SDN3 system in soybean and canola with donor DNA cassette flanking with target sites resulting in releasing the donor DNA molecule from T-DNA. The technological advances in SDN2 and SDN3 system were made without using selectable marker gene inside the donor template. Other types of genome modifications, such as targeted nucleotide editing and gene replacement (swap), will also benefit from this approach Example 5: Target Sites Flanking the Donor DNA or Polynucleotide Modification Template Improve the Frequency of HDR at a Double-Strand Break, Independent of the Double-Strand-Break-Inducing Agent and Independent of the Method of Introduction Two different maize lines were transformed with a vector similar to that described in FIG. 16, comprising either a Ubiquitin promoter or an Oleosin promoter driving meganuclease gene expression, and further comprising morphogenic factors, and with or without target sites flanking the insertion cassette. Table 9 shows that frequency of MS26 target site integration was improved when using a vector with target sites flanking the donor sequence. The lengths of the homology region "arms" (HR1 and HR2) in each vector ranged from 807 to 1209 nucleotides in length.

TABLE 9

Frequencies of target site modification with meganuclease-mediated genome modification

| Vector IDs | # Events Analyzed | Number and % of HR2 positive events | |
|---|---|---|---|
| GS3, Ubi BBM, No Flanking TS | 20, 21, 22 | 192 | 33 | 17.0% |
| GS3, Ole BBM, With Flanking TS | 20, 23, 24 | 153 | 37 | 24.0% |

Maize cells were bombarded with a transformation vector that comprised target site sequences flanking the donor DNA cassette (Vector 18), for Cas endonuclease-mediated genome modification. Cas9 and gRNA were provided on separate constructs at a final concentration of 25 ng and 10 ng, respectively. 50 ng of the donor DNA was provided along with 10 ng each of BBM and WUS cell morphogenic factors. 800 total embryos were bombarded.

As shown in Table 10, long PCR and qPCR copy number data demonstrate that the presence of target sites (TS) flanking the donor DNA improve the frequency of SDN3 homology-directed repair in plants. The lengths of the homology region "arms" (HR1 and HR2) in each vector ranged from 378 to 419 nucleotides in length.

TABLE 10

Frequencies of target site modification with Cas endonuclease-mediated genome modification using particle bombardment introduction methods. SpyCas9 was used, along with a single guide RNA driven by a maize U6 promoter.

| TS Flanking Donor DNA | # of Plants Analyzed | HR1/HR2 Positive | Intact (long PCR positive) |
|---|---|---|---|
| No (Vector 19, Control) | 240 | 5% | 2.50% |
| Yes (Vector 18) | 258 | 16.60% | 13.5% (14.3%) |

Example 6: Additional Methods

Efficient release of the donor DNA polynucleotide can be promoted by several methods. In one method, a plurality (n) of sets of sequences can be incorporated flanking the donor DNA cassette (one depiction for n=2 is depicted in FIG. 9), which allows multiple opportunities for cleavage from a Cas endonuclease/guide RNA complex. In some aspects, two sets of sequences flank the donor DNA cassette. In some aspects, three sets of sequences flank the donor DNA cassette. In some aspects, four or more sets of sequences flank the donor DNA cassette. The number of sets for the plurality may be n=2, 3, 4, 5, 6, 7, 8, 9, 10, or greater than 10.

Methods to improve the frequency of HDR at a target site may also include a donor/template cassette that has one target site outside of the cassette, instead of two sites flanking the cassette. This results in a "hanging" template/donor fragment provided to the target polynucleotide at or near the double-strand break site.

SEQUENCE LISTING (74 sequences)

SEQ ID NO: 1 - DNA, 1311 bp, Zea mays
aggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcc

SEQ ID NO: 2 - DNA, 909 bp, Zea mays
atggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtga

SEQ ID NO: 3 - DNA, 252 bp, Agrobacterium tumefaciens
atcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatc

SEQ ID NO: 4 - DNA, 971 bp, Zea mays
ccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctag

SEQ ID NO: 5 - DNA, 91 bp, Zea mays
ctctagcaaagcacttgccatctaccgaccgccgcattccaaacagcccgacgagctagcagagcggcaggcacctccctcctcaaggaac

SEQ ID NO: 6 - DNA, 2133 bp, Zea mays
atggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaa

SEQ ID NO: 7 - DNA, 881 bp, Oryza sativa
tgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcacc

SEQ ID NO: 8 - DNA, 896 bp, Zea mays
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctt

SEQ ID NO: 9 - DNA, 82 bp, Zea mays
tccccaacctcgtgttgttcggagcgcacacacacacaaccagatctcccccaaatccacccgtcggcacctccgcttcaag

SEQ ID NO: 10 - DNA, 1013 bp, Zea mays
gtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcag

SEQ ID NO: 11 - DNA, 21 bp, Simian virus 40
ccgaagaagaagcgcaaggtg

SEQ ID NO: 12 - DNA, 375 bp, Streptococcus pyogenes
atggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgag

SEQ ID NO: 13 - DNA, 189 bp, Solanum tuberosum
gtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcag

SEQ ID NO: 14 - DNA, 3729 bp, Streptococcus pyogenes
gtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagac

SEQ ID NO: 15 - DNA, 57 bp, Agrobacterium tumefaciens
aagagaccacgggaccgccacgatggcgagctgggaggccgcaagcgggcaaggtag

SEQ ID NO: 16 - DNA, 310 bp, Solanum tuberosum
ctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 17 - DNA, 1000 bp, Zea mays
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaatt

SEQ ID NO: 18 - DNA, 77 bp, Artificial
  gRNA trracrRNA
gttttagagctagaaatagcaagttaaaataaggctagtccgttatcaacttgaaaaagtggcaccgagtcggtgct

SEQ ID NO: 19 - DNA, 4104 bp, Streptococcus pyogenes
atggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagac

SEQ ID NO: 20 - DNA, 653 bp, Zea mays
gatggggatttatccccgtggggaacggggatggggaagaaatgtctctcgcaagagttcgtgggaatccccgcgggaaatttttttgtcgcggggacggatacggggagccaaagggtgccatccctaacaccgacaccgggcctgacgctgtcgccgcagctgctcatcttgtggttgtgggctgtgcccggtttccctgttgcggattgcgggtggcagcctggcaggtgggtgcgacccgtttggattcccttgtctgggccccttgtgtcagtaccgtctgtactccgatgacatgcaccgtcgtccacagtcaagtccaaaatctcccctctttttttaacggaacagttcaaaacctccttgacgcacgctgtcgtgtaccagcactcggtggacaccacgtttgtaatccaggccgacacgtcggtcccacgtcgacaggccccaccgtccggtctgtagcgtgtacgtattcgggcgacggacgtgtcgtcgtcgtcttgcgagtcccattcccatcaccatctgagccacacatcctctgaacaaaagcagggaggcctccacgcacatccccctttctcccactccgtgtccgtggcacccaccccaaaccctcgcgccgcctccgagacagccgccgcaac

SEQ ID NO: 21 - DNA, 1917 bp, Zea mays
atggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtcgatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtcccgatggtcgccatcacgggacaggtggcgcgacgcatgattggcaccgacgccttccaggagacgcccatcgtcgaggtcacgcgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagccgtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactga

SEQ ID NO: 22 - DNA, 584 bp, Sorghum bicolor
gccgtgggtcgtttaagctgccgctgtacctgtgtcgtctggtgccttctggtgtacctgggaggttgtcgtctatcaagtatctgtggttggtgtcatgagtcagtgagtcccaatactgttcgtgtcctgtgtgcattatacccaaaactgttatgggcaaatcatgaataagcttgatgttcgaacttaaaagtctctgctcaatatggtattatggttgtttttgttcgtctcctaatatttgcctgggatcaaattttattggctggtgttcatttgacctccatgttcttgctaggctccattttttactctacagccataatatgtttgattgtttggtttgttctttgttgtacacctggttctgtcgagcttagttttcgacactggcttacagcttaacatgttgctattttattgggttctgattgctattttattgggttctgattgctagtttttgctgaatccaaaaaccatgttatttatttaagcgatccaggttattattatgatggtggctaagtttttttttttccaagggtaaattttctggattctccagtgtttctgtggcc

SEQ ID NO: 23 - DNA, 878 bp, Zea mays
tcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattg

SEQ ID NO: 24 - DNA, 795 bp, Escherichia coli
atggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctga

SEQ ID NO: 25 - DNA, 745 bp, Zea mays
ttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatc

SEQ ID NO: 26 - DNA, 2770 bp, Zea mays
gcttgcatgcctgcaggtcgactctagaggatctgcaccggacactgtctggtggcataccagacagtccggtgtgccagatcagggcacccttcggttcctttgctcctttgcttttgaaccctaactttgatcgtttattggtttgtgttgaacctttatgcacctgtggaatatataatctagaacaaactagttagtccaatcatttgtgttgggcattcaaccaccaaaattatttataggaaaaggttaaaccttatttccctttcaatctccccctttttggtgattgatgccaacacaaaccaaagaaaatatataagtgcagaattgaactagtttgcataaggtaagtgcataggttacttagaattaaatcaatttatacttttacttgatatgcatggttgctttcttttattttaacattttggaccacatttgcaccacttgttttgttttttgcaaatctttttggaaattctttttcaaagtcttttgcaaatagtcaaaggtatatgaataagattgtaagaagcattttcaagatttgaaatttctccccctgtttcaaatgcttttcctttgactaaacaaaactccccctgaataaaattctcctcttagctttcaagagggttttaaatagatatcaattggaaatatatttagatgctaattttgaaaatataccaattgaaaatcaacataccaatttgaaattaaacataccaatttaaaaaatttcaaaaagtggtggtgcggtccttttgctttgggcttaatatttctccccctttggcattaatcgccaaaaacggagactttgtgagccatttatactttctccccattggtaaatgaaatatgagtgaaagattataccaaatttggacagtgatgcggagtgacggcgaaggataaacgataccgttagagtggagtggaagccttgtcttcgccgaagactccatttccctttcaatctacgacttagcatagaaatacacttgaaaacacattagtcgtagccacgaaagagatatgatcaaaggtatacaaatgagctatgtgtgtaatgtttcaatcaaagtttcgagaatcaagaatatttagctcattcctaagtttgctaaaggttttatcatctaatggtttggtaaagatatcgactaattgttctttggtgctaacataagcaatctcgatatcacccctttgttggtgatccctcaaaaagtgataccgaatgtctatgtgcttagtgcggctgtgttcaacgggattatccgccatgcagatagcactctcattgtcacataggagagggactttgctcaatttgtagccatagtccctaaggttttgcctcatccaaagtaattgcacacaacaatgtcctgcggcaatatacttggcttcggcggtagaaagagctattgagttttgtttctttgaagtccaagacaccagggatctccctagaaactgacaagtccctgatgtgctcttcctatcaattttacaccctgcccaatcggcatctgaatatcctattaaatcaaaggtggatcccttggggtaccaaagaccaaatttaggagtgtaaactaaatatctcatgattcttttcacggccctaaggtgaacttccttaggatcggcttggaatcttgcacacatgcatatagaaagcatactatctggtcgagatgcacataaatagagtaaagatcctatcatcgaccggtataccttttggtctacggatttacctcccgtgtcgaggtcgagatgcccattagttcccatgggtgtcctgatgggcttggcatccttcattccaaacttgttgagtatgtcttgaatgtactttgtttggctgatgaaggtgccatcttggagttgcttgacttgaaatcctagaaaatatttcaacttccccatcatagacatctcgaatttcggaatcatgatcctactaaactcttcacaagtagatttgttagtagacccaaatataatatcatcaacataaatttggcatacaaacaaaacttttgaaatggttttagtaaagagagtaggatcggctttactgactctgaagccattagtgataagaaaatctcttaggcattcataccatgctgttggggcttgcttgagcccataaagcgcctttgagagtttataaacatggttagggtactcactatcttcaaagccgagaggttgctcaacatagacctattcaccccatttgatcacttttttggtccttcaggatctaatagttatgtataatttagagtctcttgtttaatggccagatatttctaattaatctaagaatttatgatattttttaattttttatcatgtctgatgagaattaacataaaggctcaattgggtcctgaattaataatagagtgaaaattaatccagaggctctattagaaccttcaattagtaataccaagatatatataagatagtagagtatagtttaaatgttggcattgttcattctttcttttgttatttaatttatgctttccacggtggttagtggttacttctgaagggtccaaataatgcatgaagagtttgaggacaagaagtctgccctaaaaatagcgatgcaaaggcatggtgtccaagccatacatatagcgcactaattttatcagcagaacaatggtatttataggtcctagtgcccaggcaacaagagacacgaataaagcatcgatcacgacac

SEQ ID NO: 27 - DNA, 225 bp, Zea mays
atggcggcgacaatggcagtgacgacgatggtgacgaggagcaaggagagctggtcgtcattgcaggtcccggcggtggcattcccttggaagccacgaggtggcaagaccggcggcctcgagttccctcgccgggcgatgttcgccagcgtcggcctcaacgtgtgcccgggcgtcccggcggggcgcgacccgcgggagcccgatcccaaggtcgtccgggcg

SEQ ID NO: 28 - DNA, 1263 bp, Zea mays
gcctgcggcctggtccaggcacaagtcctcttccaggggtttaactgggagtcgtgcaagcagcagggaggctggtacaacaggctcaaggcccaggtcgacgacatcgccaaggccggcgtcacgcacgtctggctgcctccaccctcgcactccgtctcgccacaaggctacatgccaggccgcctatacgacctggacgcgtccaagtacggcacggcggcggagctcaagtccctgatagcggcgttccacggcaggggcgtgcagtgcgtggcggacatcgtcatcaaccaccggtgcgcggaaaagaaggacgcgcgcggcgtgtactgcatcttcgagggcgggactcccgacgaccgcctggactggggccccgggatgatctgcagcgacgacacgcagtactcggacgggacggggcaccgcgacacgggcgaggggttcgcggcggcgcccgacatcgaccacctcaacccgcgcgtgcagcgggagctctccgcctggctcaactggctcaggtccgacgccgtggggttcgacggctggcgcctcgacttcgccaagggctactcgccggccgtcgccagaatgtacgtggagagcacggggccgccgagcttcgtcgtcgcggagatatggaactcgctgagctacagcggggacggcaagccggcgcccaaccaggaccagtgccggcaggagctgctggactggacgcgggccgtcggcgggcccgccatggcgttcgacttccccaccaagggcctgctgcaggcgggcgtgcagggggagctgtggcggctgcgcgacagctccggcaacgcggccggcctgatcgggtgggcgcccgagaaggccgtcaccttcgtcgacaaccatgacaccgggtcgacgcagaagctctggccgttcccatccgacaaggtcatgcagggctacgcctacatcctcacccatccaggagtcccctgcattttctacgaccacatgttcgactggaacctgaagcaggagatatccacgctgtctgccatcagggcgcggaacggcatccgcgccgggagcaagctgcggatcctcgtggcggacgcggacgcgtacgtggccgtcgtcgacgagaaggtcatggtgaagatcgggacaaggtacggcgtgagcagcgtggtcccgtcggatttccacccggcggcgcacggcaaggactactgcgtctgggagaaagcgagcctccgcgtcccggcggggcgccacctctag

SEQ ID NO: 29 - DNA, 348 bp, Zea mays
gatctgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagctactttagactgtgttcggcgttccccctaaatttctccccctatatctcactcacttgtcacatcagcgttctctttcccctatatctccacg

SEQ ID NO: 30 - DNA, 21 bp, Artificial
  gRNA crRNA for target site
gcataatgaggatcgaggatg

SEQ ID NO: 31 - DNA, 24 bp, Artificial
  target site sequence + PAM
gcataatgaggatcgaggatgagg

SEQ ID NO: 32 - DNA, 411 bp, Zea mays
cggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgagg

SEQ ID NO: 33 - DNA, 417 bp, Zea mays
atgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccg

SEQ ID NO: 34 - DNA, 411 bp, Zea mays; identical to SEQ ID NO: 32

SEQ ID NO: 35 - DNA, 417 bp, Zea mays; identical to SEQ ID NO: 33

SEQ ID NO: 36 - DNA, 411 bp, Zea mays; identical to SEQ ID NO: 32

SEQ ID NO: 37 - DNA, 422 bp, Zea mays
atgaggagcaatcattgttcaagacatgatgcaaagctagaaaactttgattgtggccgtccttgtgaagtttaggccggggggaacttcatgaaccctatcgaagcttaattagttcttttttgttgttagccatgtttgtattgtagttaaggtgaacaacatgacgccgcacccgcgatctcagggctcgtccccacacaggagggcacgtcgtcgtcttcgccgccgagcatcagagattcagagcacatacacgcacatctcaagcaaacggagtagtacgtcctactcctacgtacatacctagccgacgacctttatgtgcacaccaccactgctctgctgcccggcctctccgtcgtccgttcatcaccagcttgtcgggtccttcagtttgcatgcgtcgctccgaagtcaac

SEQ ID NO: 38 - DNA, 4439 bp, Artificial
  Donor DNA Vector 1
cggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgaggggtacctcactgactagctaatcgagctagttaccctatgaggtgacatgaagcgctcacggttactatgacggttagcttcacgactgttggtggcagtagcgtacgacttagctatagttccggacttaccgataacttcgtatagcatacattatacgaagttatggcgccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtaccgaggccggccccgcgggagctcggcgcgccatgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccg

SEQ ID NO: 39 - DNA, 4439 bp, Artificial; identical to SEQ ID NO: 38
  Donor DNA Vector 2

SEQ ID NO: 40 - DNA, 4439 bp, Artificial
  Donor DNA Vector 3
cggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgaggatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccatgtctgagccgagcccgatcgctgatccttacgcgtacctcaacattgtcaacaaccccgacgggtccatcaccagggacctctctaactttccctgcaccgcagctacacctgacccctcgcctctgaatcccgcagtgtccaaggacctgcccgtgaaccagttgaagtcgacctggttgcggctgtaccttcctagcagcgcagtcaacgagggcaacgtttcctcccagaagctcccgatcgtggtctactaccacggaggcggattcatcctctgcagcgtcgacatgcagttgttccacgacttctgctcggaggtggcgagggacctcaacgcaatcgtcgtgagcccaagctacagactggcccccgaacacaggctgccggctgcctacgacgatggagtcgaagcattggactggatcaagacgtcggacgacgagtggatcaagtcccacgcagacttctccaacgtgttcctcatgggaacctccgccggaggaaacttggcgtacaacgttggcctgaggagcgtcgactccgtctcggatctgtctcctctccagatacgcggcttgatcctccaccacccgttctttggaggcgaggagaggtcggagtccgagatcaggctgatgaacgatcaggtgtgcccccccattgtcacggacgtgatgtgggatctgagcctcccggttggagtggacagggaccacgagtactccaacccgaccgtcggagacggttcggagaagctcgagaagatcgggaggttgcgctggaaggtgatgatgataggcggcgaggacgacccgatgatcgacctccagaaggacgtggccaagctgatgaagaagaagggcgttgaggtcgtcgagcactataccggaggccacgttcacggtgccgaaatccgcgacccctcaaagagaaagacgctgttcctcagcatcaagaacttcatcttctcggtcctctagggtaccgttaacagatctactaactatctatactgtaataatgttgtatagccgccggatagctagctagtttagtcattcagcggcgatgggtaataataaagtgtcatccatccatcaccatgcgtggcaacgtgagcaatgacctgattgaacaaattgaaatgaaaagaagaaatatgttatatgtcaacgagatttcctcataatgccactgacgacgtgtgtccaagaaatgtatcagtgatacgtatattcacaatttttttatgacttatactcacaatttgtttttttactacttatactcacaatttgttgtgcgtaccataacaatttcgatcgaatatatatcagaaagttgacgaaagtaagctcactcaaaaagttaaatgggctgcggaagctgcgtcaggcccaagttttggctattctatccggtatccacgattttgatggctgagggacatatgttcgcttatgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccg

SEQ ID NO: 41 - DNA, 4444 bp, Artificial
  Donor DNA Vector 4
cggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgaggatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccatgtctgagccgagcccgatcgctgatccttacgcgtacctcaacattgtcaacaaccccgacgggtccatcaccagggacctctctaactttccctgcaccgcagctacacctgacccctcgcctctgaatcccgcagtgtccaaggacctgcccgtgaaccagttgaagtcgacctggttgcggctgtaccttcctagcagcgcagtcaacgagggcaacgtttcctcccagaagctcccgatcgtggtctactaccacggaggcggattcatcctctgcagcgtcgacatgcagttgttccacgacttctgctcggaggtggcgagggacctcaacgcaatcgtcgtgagcccaagctacagactggcccccgaacacaggctgccggctgcctacgacgatggagtcgaagcattggactggatcaagacgtcggacgacgagtggatcaagtcccacgcagacttctccaacgtgttcctcatgggaacctccgccggaggaaacttggcgtacaacgttggcctgaggagcgtcgactccgtctcggatctgtctcctctccagatacgcggcttgatcctccaccacccgttctttggaggcgaggagaggtcggagtccgagatcaggctgatgaacgatcaggtgtgcccccccattgtcacggacgtgatgtgggatctgagcctcccggttggagtggacagggaccacgagtactccaacccgaccgtcggagacggttcggagaagctcgagaagatcgggaggttgcgctggaaggtgatgatgataggcggcgaggacgacccgatgatcgacctccagaaggacgtggccaagctgatgaagaagaagggcgttgaggtcgtcgagcactataccggaggccacgttcacggtgccgaaatccgcgacccctcaaagagaaagacgctgttcctcagcatcaagaacttcatcttctcggtcctctagggtaccgttaacagatctactaactatctatactgtaataatgttgtatagccgccggatagctagctagtttagtcattcagcggcgatgggtaataataaagtgtcatccatccatcaccatgcgtggcaacgtgagcaatgacctgattgaacaaattgaaatgaaaagaagaaatatgttatatgtcaacgagatttcctcataatgccactgacgacgtgtgtccaagaaatgtatcagtgatacgtatattcacaatttttttatgacttatactcacaatttgtttttttactacttatactcacaatttgttgtgcgtaccataacaatttcgatcgaatatatatcagaaagttgacgaaagtaagctcactcaaaaagttaaatgggctgcggaagctgcgtcaggcccaagttttggctattctatccggtatccacgattttgatggctgagggacatatgttcgcttatgaggagcaatcattgttcaagacatgatgcaaagctagaaaactttgattgtggccgtccttgtgaagtttaggccggggggaacttcatgaaccctatcgaagcttaattagttcttttttgttgttagccatgtttgtattgtagttaaggtgaacaacatgacgccgcacccgcgatctcagggctcgtccccacacaggagggcacgtcgtcgtcttcgccgccgagcatcagagattcagagcacatacacgcacatctcaagcaaacggagtagtacgtcctactcctacgtacatacctagccgacgacctttatgtgcacaccaccactgctctgctgcccggcctctccgtcgtccgttcatcaccagcttgtcgggtccttcagtttgcatgcgtcgctccgaagtcaac

SEQ ID NO: 42 - DNA, 6720 bp, Artificial
  optimized Cas9 cassette
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 43 - protein, 9 aa, Simian virus 40
MAPKKKRKV

SEQ ID NO: 44 - protein, 18 aa, Agrobacterium tumefaciens
KRPRDRHDGELGGRKRAR

SEQ ID NO: 45 - DNA, 28390 bp, Artificial
  pVIR9
gacccgcgaggtttctcgcttcaattgaaatcataaagaagcaattgaaaattttcgagtaaccgaccctcccgataatcttcaacataaaacaacgcacttcttccaacgggagaggcggtgttagttgcgagctaaggagataaggtatgcttaagagatcggggtcgctttctcttgccttgatggtctccttctgttcgtcgagccttgccacgccactctcatctgctgagtttgaccatgttgctcgcaagtgtgccccatcagttgcgacatctacgcttgcggcgatagctaaggtggagagtcgctttgatcctttagcgattcatgacaacacgaccggcgaaacgcttcactggcaagatcacagccaagcaacccaagtcgtcaggcaccgtctcgatgcacggcattcgctggatgttggcctcatgcaaataaactctcgaaatttttctatgctcggtctgacacctgacggtgcgctccaggcgtgcacatcattatctgccgctgcaaacatgctgaaaagtcgttatgcaggcggcgaaacgattgacgagaagcaatttgcgcttcgtcgggcgatctccgcttacaacaccggtaatttcatcggcggttttgcaaacggctacgtgcgaaaagttgaaacagctgctcaatcgctggtgcccgcgttaatcgagcctccaaaagacgatcacgaggcgctaaaatccgaagagacgtgggatgtttgggggtcatatcagcgccgctcgcaggaggatggcgctggcggtttaatcgctccgccaccgccacaccaggacaacggcaaatccgcagacgacaatcaagtcttattcgacttatactaaggaggtgcgcattgatgcgatgctttgagagataccgtttacatctaaatcgcctctcgctctcgaatgcgatgatgcgcgtgatatcgagctgcgccccaagcttgtgcggtgcaattgcatggagcatttcctcatccggacccgccgcagcgcaatctgcgggtggcggcactgaccccgccacaatggttaacaatatatgcacgtttatccttggtccgttcggccagtcactcgctgttctcggcattgtcgctatcgggatctcctggatgttcgggcgggcttcgcttgggctggttgccggcgtcgtcggcggcattgttatcatgtttggggcgagcttcctcggccaaacgctcactggcggtagttgatggctgatcgtttggaagaatcgaccctttacctcgcagccacacggcccgcattgtttcttggggtgccactgacattggcagggttattcatgatgttcgccggctttgtcatcgttatcgttcagaacccgctctacgaagtcgttctcgtgccgttatggtttgcagcccggctcatcgtggagcgagactacaatgcggcgagcgtcgtcctgctatttttgcggaccgcgggaagaagcattgatagtgcagtttgggggggcgctactgttagcccaaatccaattagggttcccccacgagggagaggaatggtgtgatgctcggcgcgagtggaacgaccgaaagatccggtgagatctatctcccttatattggccacctcagcgaccatatcgtccttcttgaagacggatcgatcatgaccattgcgagaattgatggcgttgcattcgagcttgaggaaactgaaatgcgcaatgcgcgttgtcgtgcgttcaacacgctgttgcgcaatatcgctgatgatcatgtgtcaatatatgctcacctcgtacgtcatgccgacgtgccatcatcggcgccgcgacacttccgtagtgttttcgccgctagcctgaacgaagcttttgaacagcgcgtgctctccggccaactcctccgcaatgaacacttccttacgttgattgtctacccacaggcggctttagggaaggtaaagaggaggttcaccaagctaagcggaaaaagggaaaacgatctcacgggccagatcaggaacatggaagatctttggcatgttgtcgctggctctcttaaagcgtatggcctgcatcgtcttggcatccgcgagaagcagggtgtgctcttcaccgaaattggcgaagcgctacggttgatcatgactggtcggttcacaccggttccggtcgtcagcggctcactcggcgcttcgatttataccgacagagtcatttgcggcaagcgaggactcgagatcagaacgccaaaagacagttacgttggatccatctattcgtttcgcgaataccctgcaaaaacacggccgggcatgctcaacgcgctgctatccctcgattttccacttgttctcacgcagagtttttcgttcctgactcgcccgcaagcgcacgcgaaacttagcctcaaatcgagccagatgctgagttccggcgataaagccgtgactcaaatcggcaaattatccgaggctgaggacgcacttgcgagcaacgaattcgttatgggctcacatcatttgagcctttgcgtctatgcagacgatctcaatagtcttggggacaggggcgcgcgggctcggacacgaatggcggatgcaggtgccgtggttgtccaagaaggtattggtatggaagcggcctattggtcccaattgccggggaattttaagtggcgcacacgccctggcgcaatcacttcacgcaatttcgcagggtttgtctctttcgaaaactttccagagggcgccagctcaggccactggggcaacgcgattgcccgatttcgtaccaatggcggaacgcctttcgactatatcccgcatgagcacgatgttggcatgacggcaatattcgggcctatcgggaggggtaagacgacgctcatgatgtttgttctagccatgctcgaacagagcatggtcgaccgtgcaggtacggtcgtgttctttgacaaggaccggggtggcgaattgctggttcgcgccacaggaggaacatatttggcacttcacagaggcacacccagcgggttggcgccgttgcgtggcctagaaaacacagcagcctcacacgattttctgcgcgaatggatcgtggctctcatcgagagtgatggtcggggtgggatttctccggaagagaaccgccgtctggtccgtggtatccatcgtcagctctcgtttgatccacaaatgcgttcaatcgcggggttacgtgaatttttgttgcatgggcccgccgaaggcgcaggagcgcggctccaacgctggtgccggggccatgcgcttggctgggcatttgacggcgaagttgacgaagtaaagttagatccgtcgattaccggcttcgacatgacgcatcttctcgaatacgaggaagtatgcgctcccgctgcagcatatctcctgcatcggattggagccatgatcgacggccgccgttttgtgatgagctgcgatgagtttcgcgcctatttgttaaaccctaaattttcgactgtcgtcgacaaattcctcctgaccgttcgaaaaaacaacgggatgctaatactggcaacgcagcaaccagagcatgttctggaatcgccgctaggagccagcttggttgcgcaatgtatgacgaagattttctatccatcaccaaccgcagatcgatcggcttatgtcgatggactgaaatgtaccgaaaaggaatttcaggcgatccgtgaagacatgacggtcggcagccgtaagtttcttcttaaacgagaaagtggaagcgtcatctgcgaatttgatctgcgggatatgcgtgaatatgtcgccgtgctttcggggcgtgccaacacggtgcgctttgcaactcgactacgcgaggcacaagaaggcaactcatctggctggctcagcgaattcatggcccgtcaccacgaggcagaagattgataaggtaggaaacgatgaagacgacgcaacttattgcaacagttttgacctgcagctttctatatattcagcccgcgcgggcgcagtttgttgttagcgacccggcaacggaggctgagacgctcgcgactgcgctcgcgactgcggagaatctcactcagactatagcgatggttacgatgttgacgtcggcctacggcgttactggactactgacttcgctcaaccagaaaaatcagtatccttcgacgaaggacctagacaatgaaatgttttcgccgcgaatgccaatgtcgaccacggcacgtgcgatcaccagcgatacagatcgtgcagtcgtgggtagtgatgctgaagcggacctgttgcgatcgcagatcaccggttccgcaaacagcgctggcattgcggctgacaatctggaaacgatggacaaacgcttgacggcgaatgctgatacgtctgctcagctttcccgatctcgcaatatcatgcaggcaaccgtgaccaatggtttgcttctcaagcagatccatgacgcaatgattcaaaatgtacaggcgacaagcctattaacgatgactaccgcgcaggccggccttcacgaggcggaagaggcggccgctcaacgcaaggagcatcaaaagaccgctgtcatctttggtgccctcccctaaggctgggcgatttgttcatccgcccgcatcctcgccgaatgcgagctcattttatccaacattatgcgacaaaccagtcaagttcaggtccaatcgatgaatttcacgattccggcgccgtttacggccattcatacgatcttcgatgtagccttcacgacaggcttggactcgatgcttgagactatccaggaggcggtgagtgcgccattgatcgcctgtgtcactctttggattattgttcagggtattttagtcatacgcggcgaagtcgatacccgtagcggtatcactcgggtgatcacggtcaccatcgttgttgctctaattgttgggcaggctaactaccaagactatgtggtttccatcttcgaaaagacggtcccaaactttgttcagcagtttagtgtaaccggcttgcctctgcagactgttccggcacagttggatacaatgttcgccgtgacccaggccgtttttcagaaaatcgcatccgaaatcggtccgatgaacgaccaggacatccttgctttccaaggggcacagtgggtcctttacggcacgctctggtctgccttcggagtttacgacgccgttggaattctcacgaaagtgcttctcgcgatcgggcctctgatcctcgtcggatatatttttgatcgcacgcgggacatcgcagctaagtggatcgggcaacttatcacctacggtctcttgcttctcctcttaaacctcgtggcaacgatcgtcatcctaaccgaagcgactgcgctcacccttatgcttggtgtaatcaccttcgccggtacgaccgcggccaagatcattggtctttacgaactcgatatgttttttctgacaggggatgcgctcattgtcgctttgccggcgatcgccggcaacattggaggcagttactggagcggcgcaacccaatctgccagcagcttgtaccgtcgcttcgctcaggttgagcgaggctaggtcgcgcaaaaattcgcctcaatggagaattctatgaagtattgcctgctgtgcctagttgtcgctttgagcggctgccagacaaacgacacattagcgagctgcaaaggcccgatcttcccgctgaatgtggggcgatggcagcctactccgtcagatcttcagctcggcaattcgggtggacgctatgacggggcctgaatatgccatgctagtggcgcgcgaaagccttgccgagcactataaggaagtagaagcctttcaaaccgcgcgagcgaaatcggcgcgacgtctctccaaactcattgcagctgtcgcagctatcgcgattttgggaaatgttgctcaagcgttcgctatagccacaatggtgccgttgagcaggcttgtgcccgtatatctatggatacggccggacggcaccgttgacagcgaggtgtctgtctcgcgattgcctgcaactcaagaggaggccgtcgttaacgcctcattgtgggagtacgttcgcctgcgcgagagttatgatgccgacaccgctcagtacgcctacgacctggtatcgaacttcagtgccccaacagtgcgccaggattaccagcaattcttcaactatcccaatcccagttcgcctcaagtcattcttggcaaacgcggcagggtggaggtcgagcacatcgcttcaaatgatgtaactccaagcacgcagcaaattcgctataaaaggaccctcgtcgttgacggcaaaatgcctgtggtgagtacgtggaccgcgacagttcgctacgaaaaggtgaccagcttgcccggcagattgagactaaccaacccggcaggtctggttgtcacctcctatcagacatcggaagataccgtttcaaacgtaggccacagcgaaccatgatcagaaaagcacttttcattttagcatgtttatttgccgctgcgactggtgcggaggctgaagacactccaatggcgggcaagctagatccgcgcatgcgttatttggcttacaatcccgatcaagtggtgcgcctctcgacggcggttggagctactttggtcgtaacattcgccacgaacgaaacggtgacagcggttgccgtttcaaatagcaaagatctagcagccctaccgcggggaaattatctatttttcaaggcaagccaggtcctcacgcctcagccagtaatcgtgctaaccgcaagcgactccgggatgcgccgttatgttttcagtataagttccaagactctgtcccacctcgataaagagcagcccgatctctattacagcgtccaattcgcctaccccgccgacgatgcggcggctcggcgaagggaggcacaacagaaggctgttgtggacagactacacgcggaagcacaatatcaacggaaagctgagaatttattggatcagcctgtcacagcccttggtgcggcggacagtaattggcactacgtcgcccaaggcgatcgttcgctgttgccactcgaagtcttcgacaatggatttacgacggtattccactttccgggcaatgtacgcataccctccatctacaccatcaatcctgatggcaaggaagctgttgccaactattcagttaaagggagcgatgtcgagatttcttcggtttcccgaggttggcgtctgagggatggccacacagtactatgtatctggaacaccgcttacgatcccgttggccaaaggccgcaaacgggcacggtgaggcccgatgtgaaacgcgtcctgaagggggcgaagggatgaataacgatagtcagcaagcggcacatgaggttgatgcatctggatccctggtctccgacaaacatcgccggcgtctttcggggtctcagaaattgatcgtcggaggtgtcgttctcgcgttatcattaagcctcatttggctaggtgggcgccaaaagaaggtgaatgagaacgcatcgccgtcaactttgatcgcaacaaacaccaagccatttcatccagctccgattgaggtgccgccggatcctccagcggttcaagaggctgttcagcctgctgctcctctaccgccgaggggcgaaccggagcggcatgagccacggccggaagaaacaccgatttttgcatatagcagcggcgatcaaggggtcagcaaacgcgccattcagggcgacacgggccgaagacaagaaggcaagcgtgacgacaactccttgccgaatggcgaagtgtccggcgagaacgatttgtcgatacgtatgaaacccaccgagctgcagcccagcagcgccacgctcttgccgcaccccgattttatggtaacgcaagggacaataattccgtgcatcttgcaaaccgcaatcgacacaaatttggcaggctatgtaaagtgtgtcttgcctcaggatattcgtggaacaacgaacaatatcgtgcttcttgatcgtggcaccaccgttgttggcgaaatacagcgtggcttgcaacagggagatgggcgcgtttttgtgttgtgggatcgcgccgagacacctgaccatgcgatgatctcgttaacatcgccaagcgcggacgaactcggtcgctcaggattgccgggctcggtcgacagccacttctggcagcgttttagcggagctatgctcttgagtgttgttcaaggcgccttccaggcagctagcacctacgccggcagctcgggtggcgggatgagcttcaacagctttcaaaataacggtgagcagacaactgagacagcccttaaggcaaccatcaacataccgccaaccctgaagaagaatcagggtgacaccgtttccattttcgtagcacgggacctcgatttctttggtgtttaccagctccgcctgactggcggcgccacgcgggggaggaaccgccgctcttaatgaattcaaatttccgcttagagataggatacattgtaaatggaagtggatccgcaactacgctttcttctgaagccgattttggaatggctcgatgacccgaagactgaagaaattgcgatcaatcgacctggagaggcatttgtgcgccaagccggcatttttaccaagatgcctttgcccgtctcttatgatgatcttgaagatatcgctattttagcgggcgcgctgagaaagcaggatgtcggaccacgtaaccccctctgcgccactgaacttcctggtggtgaacgactacaaatctgtctgccgccgaccgttccctcgggcaccgtcagcttgaccattcgacggccaagctcgcgtgtttctggtcttaaagaagtctcctcccgttatgatgcttcgaggtggaaccagtggcagacacgaaggaaacgccaaaatcaggatgatgaagctatccttcagcattttgacaacggggatttggaagcgtttctgcacgcatgcgtcgtcagccgactgacgatgttgctatgtggccctaccggaagcggcaagacaacaatgagcaagaccttgatcagcgccatccccccccaggaaaggctaatcaccatagaagatacgctcgaactcgtcattccacacgataatcatgttagactactctactccaagaacggtgctgggctgggtgctgtgagcgccgagcacttgctccaagcaagtctgcgtatgcggccggaccggatattgcttggcgagatgcgcgacgatgcagcatgggcttatctgagtgaagtcgtctcgggacatccgggatcgatttcaacaatacacggcgcgaatccaatccaaggattcaagaaactgttttcccttgtcaaaagtagcgcccaaggtgctagcttggaagatcgcacactgattgacatgctctctacggcgatcgatgtcatcattccattccgtgcctatgaggacgtttatgaagtaggcgagatctggctcgcggcggacgcacgacgccggggcgagaccataggcgatctccttaatcaatagtagctgtaacctcgaagcgtttcacttgtaacaacgattgagaacttttgtcataaaattgaaatacttggttcgcattttcgtcatccgcggtcagccgcaattctgacgaactgcccatttagctggagatgattgtacatccttcacgtgaaaatttctcaagcgctgtgaacaagggttcagattttagattgagaggtgagccgttgaaacacgttcttcttatcgatgacgatgtcgctatgcggcatcttattatcgaataccttacgatccacgccttcaaagtgaccgcggtagccgacagcacccagttcactagagtactctcttccgcgacggtcgatgtcgtggttgttgatctaaatttaggtcgtgaagatgggcttgagatcgttcgaaatctggcggcaaagtctgatattccaatcataattatcagtggcgaccgccttgaggagacggataaagttgttgcactcgagctaggagcaagtgattttatcgctaagccgtttagtacgagagagtttcttgcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttacgacaggagtatagatgttctcattttgcggctgcgccgcaaacttgaggcggatccgtcaagccctcaactgataaaaacagcaagaggtgccggttatttctttgacgcggacgtgcaggtttcgcacggggggacgatggcagcctgagccaattgcatttgattaatttaggtgactgaggacgcggccagcggcctcaaacctacactcaatatttggtgaggggttccgataggtccctcttcaccaattgctcgatggcttctctccagcaaagaatgacgcgagcgcggcggtagccagcttgtggccgaaagctcgagcggtctccaaccccaacggatcaaaatgacttcgagcgacctcgagcaacgcaaccgggaacatgcgtgaggtctgaacgagaacggatttttctgtagttgaagggatcggataacttttcggggccacgcgaaatgatccatctgccagcatgctttcgaaatcgtccaacgcgcgccttaaaatcatttgtagcgacttcgagggactgtattgccgaacgaggttgtcatatgttttcgacacttgaggcgcgggcggtcgcgctgaaagaaaaacctggagctttttcggggacggaggtggactaagggcatccacagttagcttaagttgtcgatcgggactgtaaatgtgatcggcgacgagaggctcacgttgctggtctttctcgtcggctttttcaggcaagtgctggaggtccagcttctggggaacaagtgtcgggttgggatggtggatctcgggtcgagcaccagcaagccgccgtgcttcgccgaccgacaatgcgggcttgcgaattgccatcttcaagcctccaagattttgctgatcagtttcgaaatgaccacgacttcctccatcgcaatccgaagattcctctctatgaggcgcatcgtcggatcagttcccgtgtttagtaatgtaagatgcaacatgccgcgttctttcatcgcggcaaatgcatctctttcatgcatgggagacggtacaactggaaggctctctagcgtctctgacatcctgcgttgcgatgttgtcaatcggccgaccgggacgcgttggcgcaaaacagctgtaggaattgccaaattttcactcaacagcagctcgatgacgtagcggtaggtagatagtgcctcatcgatgtcgagcggcgttagcatggtggggatcagaagcaggtttgagctagcgatgattgtgttgttgagctcgctcgagccgccacgcgtatcggccaacgcataatcaaatccttcgagctcggcattttcataggctgcttcaagaaggggcatttcgtcggcggaatagacttcacagcgaggatcccaggtactgctttgtaaggcgttttctctccatcgcgtcagaggccggttttcgtcggcatcaaagagggccactcgtttaccgtcatttgccaaagcagcgcaaaggcccatgagtgcggtggttttgccagcaccccctttgaaagaacaaaacgtcaaaagttgcatattctgatcccgcctatcctgtgaaaccggagtgcatttgtatttttgttcgtataaatgtttttgtgattatcgatgagtaaaagcgttgttacactatttttatttcacattcgttataagacaattgcaaatgtagcaagtatattcagtattgactgtaaatgtactgttgatttcatattgagcagggctagacttccatccgtctacccgggcacatttcgtgctggagtatccagaccttccgctttctttggaggaagctatgtcaaaacacaccagagccacgtcgagtgagactaccatcaaccagcatcgatccctgaaagttgaagggttcaaggtcgtgagtgcccgtctgcgatcggccgagtatgaaaccttttcctatcaagcgcgcctgctgggactttcggatagtatggcaattcgcgttgcggtgcgccgcatcgggggctttctcgaaatagatgcagacacacgagaaaagatggaagccatacttcagtccatcggaatactctcaagcaatgtatccatgcttctatctgcctacgccgaagaccctcgatcggatctggaggctgtgcgagatgaacgtattgcttttggcgaggctttcgccgccctcgatggactactgcgctccattttgtccgtatcccggcgacggatcgacggtcgctcgttactgaaaggtgccttgtagcacttgaccacgcacctgacgggagaaaattggatgcccgatcgcgctcaagtaatcattcgcattgtgccaggaggtggaaccaagacccttcagcagataatcaatcagctggagtacctgtcccgaaagggaaagctggaactgcagcgttcagcccggcatctcgatattcccgttccgccggatcaaatccgtgagcttgcccaaagctgggttacggaggccgggatttatgacgaaagtcagtcagacgatgacaggcaacaagacttaacaacacacattattgtaagcttccccgcaggtaccgaccaaaccgcagcttatgaagcaagccgggaatgggcagccgagatgtttgggtcaggatacgggggtggccgctataactatctgacagcctaccacgtcgaccgcgatcatccacatttacatgtcgtggtcaatcgtcgggaacttctggggcaggggtggctgaaaatatccaggcgccatccccagctgaattatgacggcttacggaaaaagatggcagagatttcacttcgtcacggcatagtcctggatgcgacttcgcgagcagaaaggggaatagcagagcgaccaatcacatatgctgaatatcgacgccttgagcggatgcaggctcaaaagattcaattcgaagatacagattttgatgagacctcgcctgaggaagatcgtcgggacctcagtcaatcgttcgatccatttcgatcggacgcatctgccggcgaaccggaccgtgcaacccgacatgacaaacaaccgcttgaaccgcacgcccgtttccaggagcccgccggctccagcatcaaagccgacgcacggatccgcgtaccattggagagcgagcggggtgcccaaccatccgcgtccaaaatccctgtaactgggcatttcgggattgagacttcgtatgtcgctgaagccagcgtgcccaaacaaagcggcaattccgatacttctcgcccggtgactgacgttgccatgcacacagtcgagcgccagcagcgatcaaaacgacgtcatgacgaggaggcaggtccgagcggagcaaaccgtaaaagattgaaggccgcgcaagttgattccgaggcaaatgtcggtgagcccgacggtcgcgatgacagcaacaaggcggctgatccggtgtctgcttccatccgtaccgagcaaccggaagcttctccaacgtgtccgcgtgaccgtcacgatggagaattgggagaacgcaaacgtgcaagaggtaatcgtcgcgacgatgggcgcggggggacctagactagtagacaggaaggaccgaataatggcaaatggtcagttcacgatacgctctgctcgcccggcctccgtcggactgacaggcgaacggcgtggagccgcatccgcctctagctctgcactgtccaatgttcaaagagatgttagggataggctgattccaactagctcaccaagattaccaaatgcagccatattgcgtgattcctcgggaagagcgtcgactggtctgcggtacatggcggctactcttcattggtctgcgatcgcgccattatcgctaataaacagcaacgacctggctccggccgcttatgactttgagacgcgaaataacgcaagaaatgtgactgccaaagtcggcagggcagtccctgttcccaagcaaggcgggctcggcaaaacgctcgcacccgtaccccttagtacacgtatatcaagggtcaattccgaccgaagactgcccgctgacgcagaagaccgccctgaaacgcgcgacccccagaaaggacgtggcagtcatggtgcgacgccaaccttacatgaaaagattggaaccgcgtttgctcgaagattgcgaaagcatacgtactatattgtttgcagttgctgccagacccggagcgcgttgacgatgggtgcaaagatttcggtgaagtcatgaactccagcaagacttcgccccagcgtatgaccctgagcatcgtatgttcgctggcagccggtttttgtgcggccagctgctatgtaacgttccgccggggcttcaacggcgaagcgatgatgacgttcgacgttttcgctttttggtatgagaccccgctttacttgggttatgccagcaccgtcttctggcgtggtttatctgttgtcatctttacctcgctgatcgttctttcaagtcagctcatcatatcgctgcgcaatcagaagcatcatgggacagctcgttgggcagaaattggcgaaatgcggcatgctggttatctgcagcgttacagtcgcatcaaggggccgatctttggaaagacatgtggtcccctttggttcggcagttatttgaccaatggcgaacagccacacagtcttgtcgtcgcgccaacgcgtgctggcaaaggcgtcggcatcgtcattccaacgctgttgaccttcaagggctcggtaatcgcccttgacgtcaagggagaattgtttgaactgacgtccagagcacgcaaagcgagcggcgacgcagttttcaagttctcccccctagatcctgagcggaagactcattgttacaatccggtcctggatattgccgcacttccgcccgaacgccagttcactgaaacacgccgtctagctgcgaaccttattacggctaagggaaagggagcagaaggctttattgacggcgcacgtgacctgttcgtcgcgggaatccttacctgcattgagcgtggcacaccaacgattggcgcggtatatgacctatttgcgcagcctggcgaaaagtataagctttttgcgcaactcgcggaggaaagcctaaacaaagaggctcagcgtatcttcgataatatggcgggcaacgacacgaaaattctgacatcgtacacctctgtgctgggcgacggtggactgaacctgtgggctgatccgcttatcaaagcagcgacaagccggtcagacttttccgtttacgatctccggaggaagaagacctgcatttatctttgtgtcagtcccaacgatctggaggtcttggcaccacttatgcgcctgatgtttcagcagctcgtgtcaatcttgcagagatcgctgccaggtgaagacgagtgccatgaagttttatttctcctcgacgaattcaaacacctgggcaagcttgaggccatagagaccgcgatcacaaccatcgccggttacagaggccgctttatgtttattattcaaagtctttcggccttgtcgggcacatacgatgacgcaggaaaacaaaactttctgagcaatactggcgtacaagtatttatggccacggctgatgacgaaactccaacctacatctcaaaagctatcggcgaatatacgtttaaagcgcgttcgacctcttacagtcaagccagaatgttcgaccacaacatccagatttctgatcaaggtgcagcccttttgcgccccgaacaagtgcgcctgctagacgatcagagtgaaatcgttctcatcaaagggcgacctccactcaaattacgaaaggtgcagtattattccgatcgtacgctgaaaggccttttcgaacgccagatgggctctctgcctgagcccgcacccttgatgctttccgactatagcaacgatcaagttcaataccacttggctccgatagcaaattttaatgaggatgctgcaccgcaaaacagaactgtggccgaggaccatggaagtgttaaagtcggtgctgatatccctgaacgcgtgatgggaataaatggtgacgaggaacaagccgatgcgggcgagataccgccggaatcggttgtgcctccagaattgacgctcgctctgaccgctcaacagcaattgttggaccagattattgcacttcagcaaagatcgaggtccgcaccggcatagcctgcgaaatgatcttaatggtgcaattcgtttcaggcggcatgttgcggttcaacaaagtgtacgccagatcccaattggccctttacgaggtgtcggtatgacaggaaagtcgaaagttcacataagaggttcggctgacgcgcttcctgacgttcctggcggaagtactaccgccccttttttaaccgaaccttctcgggatcaggttgatgcctcgtttgaggtccaaaccgactacagccagtctacttccgtgtcgtttacctatgatggtgttggacttggtcctgccgagcgtgcggcttacgagaactggtgcgaaccgggccggcccacttggaaagatcttataatcaaggcacgtgtcgatccgattgacgatgtgacctggctccgagatttagaagaggacaccccctcaaccttcagatacgaagggatgcctctgggcatcggggaacgacaggcctacgaaaattggcaagaggacgctcagccgacatgggaagaccttgttgtcagcgcacgcttgacggaacttggccgtccacacgggattaccggcgagtatacatccctcgcaggatcgaagaatacaagttcaatttcattgaagcgaaagcggagcaacttaattgatgatgagaattcatccggatcgttttcatatgacgggatgaagctcggggaagccgagcgttctgcatatggtgactgggccgaggcggagccacccacgtggaaagatttggtattgagggcacgcgtttcctcgatcaatgactctgcttggctttttgattcacaaacatcttcatcatcatttgaatacaacggtgttcccttgggcgagccggaacggcaggctctcagacaatggcaaggagacgctcagcctacctgggaagatctcgttgttaacgcgcgtatggcagaactttgccatgctggttggattgaaggtcaaaaaggttgctttgaagagcgcggggaggctctgcccgcgtcggaacgcggttcgcaacgccccattggtcaacggacagattcctccgattcttttgtgtatgatggcacaaggctcggagcacctgagcgaactgcttatgaacgctggagtaagagggaacgcccgacttgggaagatctcatcttagatgcacaccaggccaggactgaaagtgacgctgttacgacccaagcgattggtcagtcgtcctcaccggttttcttatatgaaggaaagtcgctcggagacagggaacgaaaggcttacgaaaaatggcggcagccagcccaaccgcgatggcaaaatcttgtagtgaacgctcgtctggcagaaatcgatccctcagcctggattgccgatgagcgcgatccgcttgatgatagcgacgcgcttggtcgcccgtcgtacacaagcttgacggatagatcagacgtccctttagacgatcaatcaatctatcgtcgttccgacctagtaagggagcaggtgccagaatcgtctcaaaggcaattcgcagcatgttcagaatctgaaacgaggcctgtgcaatggtttactgcttctgggtcagatgcaaacaatacggaaaatatcaccgccagcgatcccgtcgatcgcacgggtggagttaagcggctaggctccaaaagcgacagaaccgttacagcttctatccatgacgtgaattccagcacaaggcgactgttgcttaacgaatttggatcggaggctccgcgcccttcgccagaaaagactgttcgcttaagaagcgacaatattggcacctatgggagccggaaaaatgaacgagcgcggctcgcgaccgaaaccggtgcgtatgagtcggagcatattttcgggttcaaggctgtccacgatactgcgagagcgacgaaagagggccggcgtctcgaaaggcccatgcccgcctaccttgaggataaggggcttcatcgccaacatattggcaccgggagaggacggaccaaacttgtcgggcgcggatggccggatgacacaagctatcgctcggatcaaagggcaactctgtcggaccccgttgcgcgctcggaaggcgcgacggcctcaaatgggtatcaattgaaccaattgggttacgcgcaccaactcgctagcgatggcctgcaaagtgaatcgcccgatggtgttgccttgccaattcaagtggcaacaacgagctacaactatacagtgagccgcgatcctgtccttgttccgccggataaaaacgaagcccctcaattgctgcatcttggtccccgtggtcaaaccgaagctgttcttgcccgcgaaacagcattgactggaaaatggccgactctcgagcgtgagcagcaagtgtatcgcgagtttttggccttatatgacgtaaaaaaagatcttgaggccaaatcagtcggcgtaagacggaaaaaaaaagaagttatttctgcgttagaccgaactgcgcgcttgataagcacgtcgccttcgaaagctcgatccaaagcagagactgaaaaagccattgatgagctcgatgatcgacgagtttatgatccgcgtgatcgagctcaagacaaagcgtttaaacgctgataagtcgccaatatagtgatcatttgcagtattcgcatcgatcgctggttgatattctgccgctggtcgaccggctgctcgtcgccaaaaatgctcacagggatacgatggcctcggtcaggccgcgtgcgtcctgtctttccagttcctccctttcagctcgattgtggcatcatttattgcctgctcattgcagttgaaacgcgatatccgtttcaagacccgggtatggatggtactttggagatatgagcacttgccagacttcccggtcggagacttaaaaattccgataagaggttacggacgacggaccttataagtggatcgtctagtggtggcgccgatcaaaacagttccgcccccggctttgctcaaagtagcaaagcagctttatctcgggttgcggaggattttctagaaaaccgcaattttgcaggagagaacatatggccatcatcaagccgcatgtgaacaaaaataggacaacctcgccgatagagagaccggagtctctcatagaggaaatgagcggcagtcatccgccgagtggttttaccaacctggatctcgctatgatcgagctggaggactttgtccatcggtgcccgctcccagaagacaatcttgctggtcagaaggagtgagacgatggatccgtctagcaatgagaatgtctatgtgggtcgcggtcacaacatcgaaaatgatgatgacactgaccccaggcgttggaagaaggcgaatatcagttccaacaccatctccgatattcagatgacgaatggcgaagacgtacaatcagggagccctacccgaacggaagttgtaagcccacgtctggattatggatcggtcgactcctcctccagcctttattctggcagcgagcacggaaatcaagctgagattcaaaaagagctgtccgtcttgttctcgaacatgtctttgccaggcaacgatcggcgcccggacgaatacattctcgtgcatcaaacgggacaagatgcttttactggtattgccaaaggcaacctcgaccaaatgcccaccaaggcggaatttaacgcgtgctgccgtctctacagggacggagccggtaattactacccgccacctctcgcattcgacaagattagcgttccagagcaactggaggaaaaatgggggatgatggaggcgaaggaacgtaacaaactgcggtttcagtacaagttggacgtatggaatcatgcgcacgctgatatggggatcacgggcacagagatcttttatcaaacagataagaacataaagctcgaccggaattataaactaagacctgaagaccgatacgtacaaacagaaaaatacgggcgccgggaaattcaaaagcgatatcaacacgaactccaggctggttcgctgctgcccgatattatgatcaaaactccccaaaatgacatccacttcgtgtacaggtttgccggcgacaattacgccaacaaacagttcagcgagtttgaacacaccgtcaagcgcaggtatggcgacgagactgagatcaaattgaagtcaaagtcaggcattatgcatgactcgaaatatctggaatcctgggaacggggcagtgcggatattcgcttcgcggaattcgttggggaaaatagagctcacaatcggcagtttccaactgcgacagtaaatatgggacagcagccagacgggcagggcggtttgacccgcgaccgtcatgtgagcgttgacttcctaatgcaaagcgcacccaattcgccttgggcgcaagctttgaaaaagggagaactgtgggatcgcgttcagttgcttgctcgcgacggcaaccgctatctgtcgccgcccagattggaatattctgaccctgcacatttcaccgagttgatgaaccgggttggtttacccgcatcgatgggtcggcaaagccatgcggctagtatcaaattcgaaaagtttgacgcgcaggcagcggttattgtcttaaatggcccagagttacgtgacattcatgacttgtctcctgaaaaactgcaaaatttgtccaccaaagatgtcatcgtcgccgatcgcaatgagaatggtcagagaactggcacgtacaccagcgtcgcggaatatgagcgcttgcagttaaggctgccacccgatgcagcgggggtgcttggtgaagcaactgacaaatattcacgtgatttcgttcggccagagccggcgtcgcgtccaatcagtgacagccgcaggatatacgaaagtcgaccgcgtagccaaagcgtcaacagcttttgacgttcctgctgccgcgtcaacgaggaagctcgtttgacccgggtttgccaatgaaagggctcaatcatggtgaacactacaaagaaaagttttgcgaagtcgcttacggcagatatgcgccgttctgctcagcgcgttgtcgagcaaatgcgaaaagcattgattaccgaagaagaggcgctcaagcggcaagccagactggagagtcccgataggaagcgaaagtatgctgctgatatggcgatagtcgacaaactcgacgtagggtttcgaggcgaaataggctataaaattcttggaaataaccggcttcgagtagacaaccataaagaattaacgcgtgagcacggtagacttcgcaaaaccaaaacggttctgaagcgtaacccggtgacgcaggaagtctatttgggtttatatgaaaggaagtcctggttaagtgtcagcagccatttgtatgctgcggacggcacactccgcatgaagcacgtgaaatacaaagacggacgttttgaggaaaaatgggagcgcgacgaaaatggcgacctgatccgcacaaggtacgccaaccgtggcaggctctttcaacctgtatccgagaaaatgggcgcgccgtatcggagcggccctgacgaccggctctatcgcgatctaacccgtcgaaacggtttcagacgggagacattcgaacgggacgatcacggaaacctcgagcgtatcggcagcaaccatgtcggcttttccaagatttcagtgaaggcacccaatcgtcaaacctcccagacgaagattcaaaaacttggtggcgctttcaacaaatcttttaggtcccttctggacaaggagggcaatgaaatgggccgcgatattttgagccatcgacggctctataacaagcggtctgctgtctacgatgaagctaccggacaattgaagagtgccaagcataccttcggcaagatctacaggagcgaaaccgaatatctcagcgcgggcctcaagaaggtttcaaaaaagatactcggggtgacggtctaccggaaatttgcggcgctcagcgagcgagaatccgaggctgagagactgcgtagttttgaatccggtgcgcatcgccagatctggcaggagcgggcagcgattcccggttcgcccctcccggagactgatgacattcatttcgcacagcagtcgcacctagccaaagccaaccctgatcacgtcgaagctgacgtcacgcgtgtgacagatcaacatgttgatgttgctggacaaacatcatcgtctccccaacggaacttggaaggatggttagattctcaatcacgatacaagccagcaaacatgctgttgtcaaatccagaccttcaagcgaacggacctcgcccatacgaagggttagctcatctcaccctccggcgcgataatgaatctgacgggcacaaggagaatgatcagcggctgcgacatttctcccagccagagccgttggtgttaccgcatcccgggtcgccggaaataactaaggtgtttggctcgcggggagagccggcacacccgagtggaaatctgcacacggcggttggagaaacggcttgcgaaggaccggtgatgtcttcatcctcggacaatcatcagccagctccaggacagcaagaacttttaagtttccttcataatgcgccagccccagtttctgtggcaatacatgatgatcaagagcgacttgcgggggaggcgcccggcggctctttcagaggtagctcagggcgaacgagttcaatgtcggagagtatcttcgacgaagatgtacaagggcatttggtacgggattattcgatcaatactactaacgggtttattgacccgcaatcgttgttcggtgaaccggacttatcgagaggtccaaaatcggggccagaaattccatcggaagattaccatttgtcagcttcggaacaggaaaatttgctgaatcaattgcttagtgtgccactgccggttccttcaccgaagcccgaatgcgcgaggtctatgattttcgaaggttcacgttcaagagagcgttccacctccagagggttctaaggtggaacgcgtctaggcttgcctatcatcaccacctcatgatggtcgcggagaccttcgaagagatatccgacatcattggagaagctgggccggaaactagtgtacctcgcgaatgcatctagatccaatccaatatgcatggcatgccgaatccatgtgggagtttattcttgacacagatatttatgatataataactgagtaagcttaacataaggaggaaaaacatatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaagtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaataatgtctaacaattcgttcaagccgacgccgcttcgcggcgcggcttaactcaagcgttagatgcactatacgtaccaatccaaatcggatccccctgcagggctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatctatcgatggtacctatctgcagacggaagggattcctgttaattaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatgcatataattgtggtttcaaaatcggctccgtcgatactatgttatacgccaactctgaaaacaactttgaaaaagctgttttctggtattt

SEQ ID NO: 46 - DNA, 33532 bp, Artificial
  Vector 1
ggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatcctgaggaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgaatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccaccttgctagttggatattacctcttctcttcaaagtatccttgaacgctcaccggttatcaaatctctacactatagctctgtagtcttgctagatagttagttctttagctctcggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggaggcagcagcagtatccaactagtcatgtatccagcctaaattgaaaagtcagatcatgtgtaacatggccctcaatatttcgatgttgccttgtggaaaaaatagctggtattggtactgtgttttttactccttccagctaccgacgttcagtgttagtgcacaaaatgttcatccatggtagtttgtctacattgcagtcatgtaaagttaaacattcacgatttctgtacttttgcatgtgtaactaaatgaaatggtgtgttacattcattccttcaatcaaataatccatagaaacaaactggtttgtaactattgtaactagtcgctagtgtccatggtattttcgattgtggaacataattagtttaatctgcttcagtataacttaagccggctttatcctgtgtatgcatcagcttcgctccattgaacatccaaacatcagtataagcattttgtggcgactaatcatccggatatcggaccgattaaactttaattcggtccgataacttcgtatagcatacattatacgaagttatatgcatacgcgtcttaagtcgatcgctatcaactttgtatagaaaagttgggccgaattcgagctcggtacggccagaatggcccggaccgggttaccgaattcgagctcggtaccctgggatccggtgcgggcctcttcgctattacgccagctggcgaaagggggatgtgctgcaaggcgattaagttgggtaacgccagggttttcccagtcacgacgttgtaaaacgacggccagtgccaagctcagatcagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgctgatccgatatcgatgggccctggccgaagcttggtcacccggtccgggcctagaaggccagcttcaagtttgtacaaaaaagcaggctccggccagaatggcccggaccgggttaccgaattcgagctcggtaccctgggatccgatatcgatgggccctggccgaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataatgaggatcgaggatggttttagagctagaaatagcaagttaaaataaggctagtccgttatcaacttgaaaaagtggcaccgagtcggtgctttttttttgcggccgcgaattcctgcagggccctcttgtcggaccagttgcccaccacgttggtgaggggcacccagctttcttgtacaaagtggcccggggcggccgaagctggccttctaggcccggaccgggtgaccaagcttggcgcgcccagggcccatcgatatcggtaccctggtcacgtgtctttataattctttgatgaaccagatgcatttcattaaccaaatccatatacatataaatattaatcatatataattaatatcaattgggttagcaaaacaaatctagtctaggtgtgttttgcgatccgatcgatggggatttatccccgtggggaacggggatggggaagaaatgtctctcgcaagagttcgtgggaatccccgcgggaaatttttttgtcgcggggacggatacggggagccaaagggtgccatccctaacaccgacaccgggcctgacgctgtcgccgcagctgctcatcttgtggttgtgggctgtgcccggtttccctgttgcggattgcgggtggcagcctggcaggtgggtgcgacccgtttggattcccttgtctgggccccttgtgtcagtaccgtctgtactccgatgacatgcaccgtcgtccacagtcaagtccaaaatctcccctctttttttaacggaacagttcaaaacctccttgacgcacgctgtcgtgtaccagcactcggtggacaccacgtttgtaatccaggccgacacgtcggtcccacgtcgacaggccccaccgtccggtctgtagcgtgtacgtattcgggcgacggacgtgtcgtcgtcgtcttgcgagtcccattcccatcaccatctgagccacacatcctctgaacaaaagcagggaggcctccacgcacatccccctttctcccactccgtgtccgtggcacccaccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtcgatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtcccgatggtcgccatcacgggacaggtggcgcgacgcatgattggcaccgacgccttccaggagacgcccatcgtcgaggtcacgcgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagccgtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgacttcgaataggtacccggggatcctctagtgccgtgggtcgtttaagctgccgctgtacctgtgtcgtctggtgccttctggtgtacctgggaggttgtcgtctatcaagtatctgtggttggtgtcatgagtcagtgagtcccaatactgttcgtgtcctgtgtgcattatacccaaaactgttatgggcaaatcatgaataagcttgatgttcgaacttaaaagtctctgctcaatatggtattatggttgtttttgttcgtctcctaatatttgcctgggatcaaattttattggctggtgttcatttgacctccatgttcttgctaggctccattttttactctacagccataatatgtttgattgtttggtttgttctttgttgtacacctggttctgtcgagcttagttttcgacactggcttacagcttaacatgttgctattttattgggttctgattgctattttattgggttctgattgctagtttttgctgaatccaaaaaccatgttatttatttaagcgatccaggttattattatgatggtggctaagtttttttttttccaagggtaaattttctggattctccagtgtttctgtggccgaattcaatcactagagtcgacctgcaggcatgcccgcggtggagctcgaattccggtccgggcctagaaggccagcttcggccgccccgggcaactttattatacaaagttgatagatatcatttaaatcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattggcggccgccggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgaggggtacctcactgactagctaatcgagctagttaccctatgaggtgacatgaagcgctcacggttactatgacggttagcttcacgactgttggtggcagtagcgtacgacttagctatagttccggacttaccgataacttcgtatagcatacattatacgaagttatggcgccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtaccgaggccggccccgcgggagctcggcgcgccatgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccgcccgggtgattccgatgacttcgtaggttcctagctcaagccgctcgtgtccaagcgtcacttacgattagctaatgattacggcatctaggaccgactagctaactaactagtacgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgggcccaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgtgggcgttaaccttctgttaacctaaaagctcttgcccaaacagcagaatcggcgctaattgccagcggcggaacttttccagtttcgcgaaaaatatcgccactggcaaggaatgggtttgagatggcgaagtctgtcctaaaagcagcgcctgtagttgtagggttgacggccttgatggagcgtcatgccgatgccctctcgagccaacttcaagcacatcatcttaaggttttcccgccgcattccgagaagggcattcgaacattcgggccatcggaggcgtccaagctgctcggcgttggcgagtcatatttacggcagaccgcgtctgagatgccagagttgaatgttagcatgagcccgggtggcaggcgaatgttctcaattgaagatatccatgcgattcggaagtatatggatcaggtcggccgcgggaaccggcgctacctgccacatcgtcgaggcggcgagcagcttcaggttatctctgtgatgaatttcaaaggtgggtcgggtaagaccaccaccgccgcgcatctggcgcagtacctcgctatgcgcggatatcgagtcttggccattgatctcgatcctcaagcgagcctttctgcactctttgggagccaaccggagacggacgttggcccgaacgaaacgctctacggcgctataaggtatgatgatgagcaggtggcaatcgaacgagtcgtccgagggacttacattcccgacctccacctgattcctggtaatcttgagctgatggagtttgaacacgatacgccacgcgcgctgatgaaccgcaaagagggcgacacgctcttttatggtcgcatcagccaagtaattgaagatatcgcggataactatgacgtcgtggtcatcgactgccctccccagcttgggtatctcacgctatccgcattgactgcggcgacgtccattcttgtcacggtccatccgcagatgctggatgtgatgtcgatgaaccagtttctggcaatgacatcgaaccttttgcgtgaaatcgagaatgctggcgccaagttcaagtttaattggatgcgctatctgataacccgtttcgaaccgagcgacggaccacagaaccaaatggtaggttatctgcggtcgatttttggcgaaaatgtcctcaattttccgatgcttaaaaccaccgcggtttcggacgctggcctgacaaaccagactctattcgaagtggagcgtggcctgttcacgcgctcgacctatgatcgagccttggaggcgatgaacgccgtcaacgacgagatcgaaacactgatcaaaaaagcatggggtaggcccacatgagccggaagcacatccttggcgtctcaactgacgcccctgagacgtcgcccgccgacaataggacggcaaagaaccgctccatgccgctcctcggcgtaacaaggaaggagcgcgatccggcaacgaagctcacagcgaacattggtaacgcactgcgagagcaaaacgatcgtcttagccgtgccgaagagatcgagcggcgtctcgctgaaggtcaggcagtgatagagttggatgcctcgtcaatagaaccgtctttcgtgcaggatcgtatgcgaggggacattgacgggctccttacttcgatccgggaacaaggacagcaagtcccaatccttgtgcgaccgcatccgagccagccgggccgatatcaggttgccttcggccaccgccggctacgcgccgtttcagaactcggacttccggtcagagcggtcgttcgcgaactgacggacgagcaagtggtcgtagcacagggtcaggaaaacaatgagcgcgaagatcttaccttcatcgaaaaggcgcgcttcgcacatcgcctgaacaggcagttttctcgagagattgtcatcgccgcgatgtcgatcgacaagagcaatttgtccaagatgcttctgctcgttgacgccctcccctctgaactgaccgatgctattggtgccgctcctggtgttggacggccgagttggcaacaacttgccgagctgattgagaaagtttcttcaccggccgacgtggctaaatatgctatgtcggaggaagttcaagcgctgccatcggcagaacgattcaaggcggtgatcgctagtctgaagcccagtcgggttgcgcgtggacttcccgaggtcatggccaccccagacggcaccagaattgcacaggtgacgcagagcaaggccaaactggaaatcacgattgacaggaaggcgacgcccgattttgcgaccttcgtgctcgatcatgtgccagcgctgtatcaagcgtaccacgctgagaaccaacggaaacggggagagtaaaccgcaaaagaaaagagccccctcaacgtcgccgtcgcggaagcccttctgtctctctagcgcgaacagaatcgcatttcctcgaatcctcgtcaagagtttttagcgccgttttggtgagctgatttcctttgcctgctgaaaggtgaaagatgatgcagacaggaagtgtaacgacgccattcgggcggcggccaatgacgcttgcgcttgtgcggcgccagacggcgctggccgatatcaaacaaggcaagacagcggacaagtggaaggtctttagagacgcgtccgcggctatggaactacttggaatccagtccaacagtcttgccgtccttgatgcgctattgagctttcacccggaaacggagttgcgtcaggaggcacagctgatcgtcttcccgtcgaatgctcagcttgcccttcgggcgcatgggatggctggcgcgactttgcgtaggcacatcgccatgctcgtggagtcaggcttgatcgtccggaaggatagcgccaacggaaagcgttacgctcgtaaggatggcgctggtcagatcgagcgcgcgtttggcttcgatttgtctccgcttctcgcgcggtcggaagagctagcgatgatggcacagcaggtgatggccgatcgagcagcattcaggatggccaaagaaagtctgacgatttgccgacgggacgttcggaagctaattacggcagctatggaagagggagcggagggcgactggcaagctgtcgaggaagtctatgtggaacttgtgggtagaattccacgcgccccgacgcttgctgatgtagagtcaattctcgaagagatgtggatgctccaggaagagataatcaaccggttggaaattagagacaattcagaaaataatagcaccaatgctgcccagagcgagcagcacatacagaattcaaaacccgaatccgttaatgaacttgaacctcgctctgaaaaggagcagggcgctaagccgagtgaaatagaccgggcaaggagcgagccgataaaagcgttccccctcgggatgatcctgaaagcatgcccgaccattggcaactatgggccgagcggtgcggttgctagctggcgtgacctcatgtcggctgcggtggtggttcggtctatgctgggggtcagcccgtcggcttaccaagacgcgtgtgaggcaatgggaccggagaatgcggcagcagcgatggcgtgcattttggagcgagcgaacttcatcaattcgcccgggggctatctccgagatctgacacggcggagcgagcttgggaagttttcacttggcccgatgataatggcgctcttgaaggctagcgggcaggggacgttgcggtttggctagaattagcgagtatggagcaggatggtctgtggtcagctgaccacagacctaataggttgaaaacatgagcgttttttggatgatcgacagaccatccgattcccggagtaccaagcgtgctctgatgggagcgataacattactcaacaagcacgaaggccccatgccgatcgttgatcgtgaaggagagcctgctctacatgcggcggtattttgccggccgaggcatgtagtcgcggagcactgcctatttactgccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaactcgaggaggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtaccgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaag

SEQ ID NO: 47 - DNA, 33607 bp, Artificial
  Vector 2
ggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatcctgaggaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgaatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccaccttgctagttggatattacctcttctcttcaaagtatccttgaacgctcaccggttatcaaatctctacactatagctctgtagtcttgctagatagttagttctttagctctcggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggaggcagcagcagtatccaactagtcatgtatccagcctaaattgaaaagtcagatcatgtgtaacatggccctcaatatttcgatgttgccttgtggaaaaaatagctggtattggtactgtgttttttactccttccagctaccgacgttcagtgttagtgcacaaaatgttcatccatggtagtttgtctacattgcagtcatgtaaagttaaacattcacgatttctgtacttttgcatgtgtaactaaatgaaatggtgtgttacattcattccttcaatcaaataatccatagaaacaaactggtttgtaactattgtaactagtcgctagtgtccatggtattttcgattgtggaacataattagtttaatctgcttcagtataacttaagccggctttatcctgtgtatgcatcagcttcgctccattgaacatccaaacatcagtataagcattttgtggcgactaatcatccggatatcggaccgattaaactttaattcggtccgataacttcgtatagcatacattatacgaagttatatgcatacgcgtcttaagtcgatcgctatcaactttgtatagaaaagttgggccgaattcgagctcggtacggccagaatggcccggaccgggttaccgaattcgagctcggtaccctgggatccggtgcgggcctcttcgctattacgccagctggcgaaagggggatgtgctgcaaggcgattaagttgggtaacgccagggttttcccagtcacgacgttgtaaaacgacggccagtgccaagctcagatcagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgctgatccgatatcgatgggccctggccgaagcttggtcacccggtccgggcctagaaggccagcttcaagtttgtacaaaaaagcaggctccggccagaatggcccggaccgggttaccgaattcgagctcggtaccctgggatccgatatcgatgggccctggccgaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataatgaggatcgaggatggttttagagctagaaatagcaagttaaaataaggctagtccgttatcaacttgaaaaagtggcaccgagtcggtgctttttttttgcggccgcgaattcctgcagggccctcttgtcggaccagttgcccaccacgttggtgaggggcacccagctttcttgtacaaagtggcccggggcggccgaagctggccttctaggcccggaccgggtgaccaagcttggcgcgcccagggcccatcgatatcggtaccctggtcacgtgtctttataattctttgatgaaccagatgcatttcattaaccaaatccatatacatataaatattaatcatatataattaatatcaattgggttagcaaaacaaatctagtctaggtgtgttttgcgatccgatcgatggggatttatccccgtggggaacggggatggggaagaaatgtctctcgcaagagttcgtgggaatccccgcgggaaatttttttgtcgcggggacggatacggggagccaaagggtgccatccctaacaccgacaccgggcctgacgctgtcgccgcagctgctcatcttgtggttgtgggctgtgcccggtttccctgttgcggattgcgggtggcagcctggcaggtgggtgcgacccgtttggattcccttgtctgggccccttgtgtcagtaccgtctgtactccgatgacatgcaccgtcgtccacagtcaagtccaaaatctcccctctttttttaacggaacagttcaaaacctccttgacgcacgctgtcgtgtaccagcactcggtggacaccacgtttgtaatccaggccgacacgtcggtcccacgtcgacaggccccaccgtccggtctgtagcgtgtacgtattcgggcgacggacgtgtcgtcgtcgtcttgcgagtcccattcccatcaccatctgagccacacatcctctgaacaaaagcagggaggcctccacgcacatccccctttctcccactccgtgtccgtggcacccaccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtcgatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtcccgatggtcgccatcacgggacaggtggcgcgacgcatgattggcaccgacgccttccaggagacgcccatcgtcgaggtcacgcgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagccgtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgacttcgaataggtacccggggatcctctagtgccgtgggtcgtttaagctgccgctgtacctgtgtcgtctggtgccttctggtgtacctgggaggttgtcgtctatcaagtatctgtggttggtgtcatgagtcagtgagtcccaatactgttcgtgtcctgtgtgcattatacccaaaactgttatgggcaaatcatgaataagcttgatgttcgaacttaaaagtctctgctcaatatggtattatggttgtttttgttcgtctcctaatatttgcctgggatcaaattttattggctggtgttcatttgacctccatgttcttgctaggctccattttttactctacagccataatatgtttgattgtttggtttgttctttgttgtacacctggttctgtcgagcttagttttcgacactggcttacagcttaacatgttgctattttattgggttctgattgctattttattgggttctgattgctagtttttgctgaatccaaaaaccatgttatttatttaagcgatccaggttattattatgatggtggctaagtttttttttttccaagggtaaattttctggattctccagtgtttctgtggccgaattcaatcactagagtcgacctgcaggcatgcccgcggtggagctcgaattccggtccgggcctagaaggccagcttcggccgccccgggcaactttattatacaaagttgatagatatcatttaaatcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgggtaacctcgtagaattcgcataatgaggatcgaggatgaggggccgccggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgaggggtacctcactgactagctaatcgagctagttaccctatgaggtgacatgaagcgctcacggttactatgacggttagcttcacgactgttggtggcagtagcgtacgacttagctatagttccggacttaccgataacttcgtatagcatacattatacgaagttatggcgccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtaccgaggccggccccgcgggagctcggcgcgccatgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccgcccgcataatgaggatcgaggatgagggaattcatcgatcgtgattccgatgacttcgtaggttcctagctcaagccgctcgtgtccaagcgtcacttacgattagctaatgattacggcatctaggaccgactagctaactaactagtacgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgggcccaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgtgggcgttaaccttctgttaacctaaaagctcttgcccaaacagcagaatcggcgctaattgccagcggcggaacttttccagtttcgcgaaaaatatcgccactggcaaggaatgggtttgagatggcgaagtctgtcctaaaagcagcgcctgtagttgtagggttgacggccttgatggagcgtcatgccgatgccctctcgagccaacttcaagcacatcatcttaaggttttcccgccgcattccgagaagggcattcgaacattcgggccatcggaggcgtccaagctgctcggcgttggcgagtcatatttacggcagaccgcgtctgagatgccagagttgaatgttagcatgagcccgggtggcaggcgaatgttctcaattgaagatatccatgcgattcggaagtatatggatcaggtcggccgcgggaaccggcgctacctgccacatcgtcgaggcggcgagcagcttcaggttatctctgtgatgaatttcaaaggtgggtcgggtaagaccaccaccgccgcgcatctggcgcagtacctcgctatgcgcggatatcgagtcttggccattgatctcgatcctcaagcgagcctttctgcactctttgggagccaaccggagacggacgttggcccgaacgaaacgctctacggcgctataaggtatgatgatgagcaggtggcaatcgaacgagtcgtccgagggacttacattcccgacctccacctgattcctggtaatcttgagctgatggagtttgaacacgatacgccacgcgcgctgatgaaccgcaaagagggcgacacgctcttttatggtcgcatcagccaagtaattgaagatatcgcggataactatgacgtcgtggtcatcgactgccctccccagcttgggtatctcacgctatccgcattgactgcggcgacgtccattcttgtcacggtccatccgcagatgctggatgtgatgtcgatgaaccagtttctggcaatgacatcgaaccttttgcgtgaaatcgagaatgctggcgccaagttcaagtttaattggatgcgctatctgataacccgtttcgaaccgagcgacggaccacagaaccaaatggtaggttatctgcggtcgatttttggcgaaaatgtcctcaattttccgatgcttaaaaccaccgcggtttcggacgctggcctgacaaaccagactctattcgaagtggagcgtggcctgttcacgcgctcgacctatgatcgagccttggaggcgatgaacgccgtcaacgacgagatcgaaacactgatcaaaaaagcatggggtaggcccacatgagccggaagcacatccttggcgtctcaactgacgcccctgagacgtcgcccgccgacaataggacggcaaagaaccgctccatgccgctcctcggcgtaacaaggaaggagcgcgatccggcaacgaagctcacagcgaacattggtaacgcactgcgagagcaaaacgatcgtcttagccgtgccgaagagatcgagcggcgtctcgctgaaggtcaggcagtgatagagttggatgcctcgtcaatagaaccgtctttcgtgcaggatcgtatgcgaggggacattgacgggctccttacttcgatccgggaacaaggacagcaagtcccaatccttgtgcgaccgcatccgagccagccgggccgatatcaggttgccttcggccaccgccggctacgcgccgtttcagaactcggacttccggtcagagcggtcgttcgcgaactgacggacgagcaagtggtcgtagcacagggtcaggaaaacaatgagcgcgaagatcttaccttcatcgaaaaggcgcgcttcgcacatcgcctgaacaggcagttttctcgagagattgtcatcgccgcgatgtcgatcgacaagagcaatttgtccaagatgcttctgctcgttgacgccctcccctctgaactgaccgatgctattggtgccgctcctggtgttggacggccgagttggcaacaacttgccgagctgattgagaaagtttcttcaccggccgacgtggctaaatatgctatgtcggaggaagttcaagcgctgccatcggcagaacgattcaaggcggtgatcgctagtctgaagcccagtcgggttgcgcgtggacttcccgaggtcatggccaccccagacggcaccagaattgcacaggtgacgcagagcaaggccaaactggaaatcacgattgacaggaaggcgacgcccgattttgcgaccttcgtgctcgatcatgtgccagcgctgtatcaagcgtaccacgctgagaaccaacggaaacggggagagtaaaccgcaaaagaaaagagccccctcaacgtcgccgtcgcggaagcccttctgtctctctagcgcgaacagaatcgcatttcctcgaatcctcgtcaagagtttttagcgccgttttggtgagctgatttcctttgcctgctgaaaggtgaaagatgatgcagacaggaagtgtaacgacgccattcgggcggcggccaatgacgcttgcgcttgtgcggcgccagacggcgctggccgatatcaaacaaggcaagacagcggacaagtggaaggtctttagagacgcgtccgcggctatggaactacttggaatccagtccaacagtcttgccgtccttgatgcgctattgagctttcacccggaaacggagttgcgtcaggaggcacagctgatcgtcttcccgtcgaatgctcagcttgcccttcgggcgcatgggatggctggcgcgactttgcgtaggcacatcgccatgctcgtggagtcaggcttgatcgtccggaaggatagcgccaacggaaagcgttacgctcgtaaggatggcgctggtcagatcgagcgcgcgtttggcttcgatttgtctccgcttctcgcgcggtcggaagagctagcgatgatggcacagcaggtgatggccgatcgagcagcattcaggatggccaaagaaagtctgacgatttgccgacgggacgttcggaagctaattacggcagctatggaagagggagcggagggcgactggcaagctgtcgaggaagtctatgtggaacttgtgggtagaattccacgcgccccgacgcttgctgatgtagagtcaattctcgaagagatgtggatgctccaggaagagataatcaaccggttggaaattagagacaattcagaaaataatagcaccaatgctgcccagagcgagcagcacatacagaattcaaaacccgaatccgttaatgaacttgaacctcgctctgaaaaggagcagggcgctaagccgagtgaaatagaccgggcaaggagcgagccgataaaagcgttccccctcgggatgatcctgaaagcatgcccgaccattggcaactatgggccgagcggtgcggttgctagctggcgtgacctcatgtcggctgcggtggtggttcggtctatgctgggggtcagcccgtcggcttaccaagacgcgtgtgaggcaatgggaccggagaatgcggcagcagcgatggcgtgcattttggagcgagcgaacttcatcaattcgcccgggggctatctccgagatctgacacggcggagcgagcttgggaagttttcacttggcccgatgataatggcgctcttgaaggctagcgggcaggggacgttgcggtttggctagaattagcgagtatggagcaggatggtctgtggtcagctgaccacagacctaataggttgaaaacatgagcgttttttggatgatcgacagaccatccgattcccggagtaccaagcgtgctctgatgggagcgataacattactcaacaagcacgaaggccccatgccgatcgttgatcgtgaaggagagcctgctctacatgcggcggtattttgccggccgaggcatgtagtcgcggagcactgcctatttactgccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaactcgaggaggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtaccgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaag

SEQ ID NO: 48 - DNA, 41034 bp, Artificial
  Vector 3
ggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagttttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatcctgaggaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgaatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcaagcttggcgcgccggtcacccggtccgggcctagaaggccacccgggggctcggcgttaggcttttagtccgctaggtggctagaccgaggttaggacgctagttcactaggggcctagtggtgttttaaggatatccccccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaaggttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccaagcttggcgcgccggtcacccggtccgggcctagaaggccacccggggcgacttattgaactagtctagggcgcggctaacaacctagcttagattgccttgtctaaacccttaggctaacgcgccacgatatccccacccagcaggcagcagcagtatccaactagtcatgtatccagcctaaattgaaaagtcagatcatgtgtaacatggccctcaatatttcgatgttgccttgtggaaaaaatagctggtattggtactgtgttttttactccttccagctaccgacgttcagtgttagtgcacaaaatgttcatccatggtagtttgtctacattgcagtcatgtaaagttaaacattcacgatttctgtacttttgcatgtgtaactaaatgaaatggtgtgttacattcattccttcaatcaaataatccatagaaacaaactggtttgtaactattgtaactagtcgctagtgtccatggtattttcgattgtggaacataattagtttaatctgcttcagtataacttaagccggctttatcctgtgtatgcatcagcttcgctccattgaacatccaaacatcagtataagcattttgtggcgactaatcatccggatatcggaccgattaaactttaattcggtccgataacttcgtatagcatacattatacgaagttatatgcatacgcgtcttaagtcgatcgctatcaactttgtatagaaaagttgggccgaattcgagctcggtacggccagaatggcccggaccgggttaccgaattcgagctcggtaccctgggatccggtgcgggcctcttcgctattacgccagctggcgaaagggggatgtgctgcaaggcgattaagttgggtaacgccagggttttcccagtcacgacgttgtaaaacgacggccagtgccaagctcagatcagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgctgatccgatatcgatgggccctggccgaagcttggtcacccggtccgggcctagaaggccagcttcaagtttgtacaaaaaagcaggctccggccagaatggcccggaccgggttaccgaattcgagctcggtaccctgggatccgatatcgatgggccctggccgaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataatgaggatcgaggatggttttagagctagaaatagcaagttaaaataaggctagtccgttatcaacttgaaaaagtggcaccgagtcggtgctttttttttgcggccgcgaattcctgcagggccctcttgtcggaccagttgcccaccacgttggtgaggggcacccagctttcttgtacaaagtggccgttaacggatcggccagaatggcccggaccgggttaccgcataatgaggatcgaggatgaggcggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgaggatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccatgtctgagccgagcccgatcgctgatccttacgcgtacctcaacattgtcaacaaccccgacgggtccatcaccagggacctctctaactttccctgcaccgcagctacacctgacccctcgcctctgaatcccgcagtgtccaaggacctgcccgtgaaccagttgaagtcgacctggttgcggctgtaccttcctagcagcgcagtcaacgagggcaacgtttcctcccagaagctcccgatcgtggtctactaccacggaggcggattcatcctctgcagcgtcgacatgcagttgttccacgacttctgctcggaggtggcgagggacctcaacgcaatcgtcgtgagcccaagctacagactggcccccgaacacaggctgccggctgcctacgacgatggagtcgaagcattggactggatcaagacgtcggacgacgagtggatcaagtcccacgcagacttctccaacgtgttcctcatgggaacctccgccggaggaaacttggcgtacaacgttggcctgaggagcgtcgactccgtctcggatctgtctcctctccagatacgcggcttgatcctccaccacccgttctttggaggcgaggagaggtcggagtccgagatcaggctgatgaacgatcaggtgtgcccccccattgtcacggacgtgatgtgggatctgagcctcccggttggagtggacagggaccacgagtactccaacccgaccgtcggagacggttcggagaagctcgagaagatcgggaggttgcgctggaaggtgatgatgataggcggcgaggacgacccgatgatcgacctccagaaggacgtggccaagctgatgaagaagaagggcgttgaggtcgtcgagcactataccggaggccacgttcacggtgccgaaatccgcgacccctcaaagagaaagacgctgttcctcagcatcaagaacttcatcttctcggtcctctagggtaccgttaacagatctactaactatctatactgtaataatgttgtatagccgccggatagctagctagtttagtcattcagcggcgatgggtaataataaagtgtcatccatccatcaccatgcgtggcaacgtgagcaatgacctgattgaacaaattgaaatgaaaagaagaaatatgttatatgtcaacgagatttcctcataatgccactgacgacgtgtgtccaagaaatgtatcagtgatacgtatattcacaatttttttatgacttatactcacaatttgtttttttactacttatactcacaatttgttgtgcgtaccataacaatttcgatcgaatatatatcagaaagttgacgaaagtaagctcactcaaaaagttaaatgggctgcggaagctgcgtcaggcccaagttttggctattctatccggtatccacgattttgatggctgagggacatatgttcgcttatgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccggcataatgaggatcgaggatgaggggtcacccggtccgggcctagaaggccagcttcggccgccccgggcaactttattatacaaagttgatcacgtgagagtctaaaaacggcccctaactaacgcttagttgcccgctagattagtcccccgttagtgcctagttagacacacgacgaactaggggctataaggatttaaatcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagggcgatccgatatcgatgggccctggccgaagcttggtcacccggtccgggcctagaaggccgcttgcatgcctgcaggtcgactctagaggatctgcaccggacactgtctggtggcataccagacagtccggtgtgccagatcagggcacccttcggttcctttgctcctttgcttttgaaccctaactttgatcgtttattggtttgtgttgaacctttatgcacctgtggaatatataatctagaacaaactagttagtccaatcatttgtgttgggcattcaaccaccaaaattatttataggaaaaggttaaaccttatttccctttcaatctccccctttttggtgattgatgccaacacaaaccaaagaaaatatataagtgcagaattgaactagtttgcataaggtaagtgcataggttacttagaattaaatcaatttatacttttacttgatatgcatggttgctttcttttattttaacattttggaccacatttgcaccacttgttttgttttttgcaaatctttttggaaattctttttcaaagtcttttgcaaatagtcaaaggtatatgaataagattgtaagaagcattttcaagatttgaaatttctccccctgtttcaaatgcttttcctttgactaaacaaaactccccctgaataaaattctcctcttagctttcaagagggttttaaatagatatcaattggaaatatatttagatgctaattttgaaaatataccaattgaaaatcaacataccaatttgaaattaaacataccaatttaaaaaatttcaaaaagtggtggtgcggtccttttgctttgggcttaatatttctccccctttggcattaatcgccaaaaacggagactttgtgagccatttatactttctccccattggtaaatgaaatatgagtgaaagattataccaaatttggacagtgatgcggagtgacggcgaaggataaacgataccgttagagtggagtggaagccttgtcttcgccgaagactccatttccctttcaatctacgacttagcatagaaatacacttgaaaacacattagtcgtagccacgaaagagatatgatcaaaggtatacaaatgagctatgtgtgtaatgtttcaatcaaagtttcgagaatcaagaatatttagctcattcctaagtttgctaaaggttttatcatctaatggtttggtaaagatatcgactaattgttctttggtgctaacataagcaatctcgatatcacccctttgttggtgatccctcaaaaagtgataccgaatgtctatgtgcttagtgcggctgtgttcaacgggattatccgccatgcagatagcactctcattgtcacataggagagggactttgctcaatttgtagccatagtccctaaggttttgcctcatccaaagtaattgcacacaacaatgtcctgcggcaatatacttggcttcggcggtagaaagagctattgagttttgtttctttgaagtccaagacaccagggatctccctagaaactgacaagtccctgatgtgctcttcctatcaattttacaccctgcccaatcggcatctgaatatcctattaaatcaaaggtggatcccttggggtaccaaagaccaaatttaggagtgtaaactaaatatctcatgattcttttcacggccctaaggtgaacttccttaggatcggcttggaatcttgcacacatgcatatagaaagcatactatctggtcgagatgcacataaatagagtaaagatcctatcatcgaccggtataccttttggtctacggatttacctcccgtgtcgaggtcgagatgcccattagttcccatgggtgtcctgatgggcttggcatccttcattccaaacttgttgagtatgtcttgaatgtactttgtttggctgatgaaggtgccatcttggagttgcttgacttgaaatcctagaaaatatttcaacttccccatcatagacatctcgaatttcggaatcatgatcctactaaactcttcacaagtagatttgttagtagacccaaatataatatcatcaacataaatttggcatacaaacaaaacttttgaaatggttttagtaaagagagtaggatcggctttactgactctgaagccattagtgataagaaaatctcttaggcattcataccatgctgttggggcttgcttgagcccataaagcgcctttgagagtttataaacatggttagggtactcactatcttcaaagccgagaggttgctcaacatagacctattcaccccatttgatcacttttttggtccttcaggatctaatagttatgtataatttagagtctcttgtttaatggccagatatttctaattaatctaagaatttatgatattttttaattttttatcatgtctgatgagaattaacataaaggctcaattgggtcctgaattaataatagagtgaaaattaatccagaggctctattagaaccttcaattagtaataccaagatatatataagatagtagagtatagtttaaatgttggcattgttcattctttcttttgttatttaatttatgctttccacggtggttagtggttacttctgaagggtccaaataatgcatgaagagtttgaggacaagaagtctgccctaaaaatagcgatgcaaaggcatggtgtccaagccatacatatagcgcactaattttatcagcagaacaatggtatttataggtcctagtgcccaggcaacaagagacacgaataaagcatcgatcacgacaccatggcggcgacaatggcagtgacgacgatggtgacgaggagcaaggagagctggtcgtcattgcaggtcccggcggtggcattcccttggaagccacgaggtggcaagaccggcggcctcgagttccctcgccgggcgatgttcgccagcgtcggcctcaacgtgtgcccgggcgtcccggcggggcgcgacccgcgggagcccgatcccaaggtcgtccgggcggcctgcggcctggtccaggcacaagtcctcttccaggggtttaactgggagtcgtgcaagcagcagggaggctggtacaacaggctcaaggcccaggtcgacgacatcgccaaggccggcgtcacgcacgtctggctgcctccaccctcgcactccgtctcgccacaaggctacatgccaggccgcctatacgacctggacgcgtccaagtacggcacggcggcggagctcaagtccctgatagcggcgttccacggcaggggcgtgcagtgcgtggcggacatcgtcatcaaccaccggtgcgcggaaaagaaggacgcgcgcggcgtgtactgcatcttcgagggcgggactcccgacgaccgcctggactggggccccgggatgatctgcagcgacgacacgcagtactcggacgggacggggcaccgcgacacgggcgaggggttcgcggcggcgcccgacatcgaccacctcaacccgcgcgtgcagcgggagctctccgcctggctcaactggctcaggtccgacgccgtggggttcgacggctggcgcctcgacttcgccaagggctactcgccggccgtcgccagaatgtacgtggagagcacggggccgccgagcttcgtcgtcgcggagatatggaactcgctgagctacagcggggacggcaagccggcgcccaaccaggaccagtgccggcaggagctgctggactggacgcgggccgtcggcgggcccgccatggcgttcgacttccccaccaagggcctgctgcaggcgggcgtgcagggggagctgtggcggctgcgcgacagctccggcaacgcggccggcctgatcgggtgggcgcccgagaaggccgtcaccttcgtcgacaaccatgacaccgggtcgacgcagaagctctggccgttcccatccgacaaggtcatgcagggctacgcctacatcctcacccatccaggagtcccctgcattttctacgaccacatgttcgactggaacctgaagcaggagatatccacgctgtctgccatcagggcgcggaacggcatccgcgccgggagcaagctgcggatcctcgtggcggacgcggacgcgtacgtggccgtcgtcgacgagaaggtcatggtgaagatcgggacaaggtacggcgtgagcagcgtggtcccgtcggatttccacccggcggcgcacggcaaggactactgcgtctgggagaaagcgagcctccgcgtcccggcggggcgccacctctagcagctcagattgctcagtcttgtgctgcattgcaaacacagcagcacgacactgcataacgtcttttccttgagatctgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagctactttagactgtgttcggcgttccccctaaatttctccccctatatctcactcacttgtcacatcagcgttctctttcccctatatctccacgtcgatgattccgatgacttcgtaggttcctagctcaagccgctcgtgtccaagcgtcacttacgattagctaatgattacggcatctaggaccgactagctaactaactagtacgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgggcccaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgtgggcgttaaccttctgttaacctaaaagctcttgcccaaacagcagaatcggcgctaattgccagcggcggaacttttccagtttcgcgaaaaatatcgccactggcaaggaatgggtttgagatggcgaagtctgtcctaaaagcagcgcctgtagttgtagggttgacggccttgatggagcgtcatgccgatgccctctcgagccaacttcaagcacatcatcttaaggttttcccgccgcattccgagaagggcattcgaacattcgggccatcggaggcgtccaagctgctcggcgttggcgagtcatatttacggcagaccgcgtctgagatgccagagttgaatgttagcatgagcccgggtggcaggcgaatgttctcaattgaagatatccatgcgattcggaagtatatggatcaggtcggccgcgggaaccggcgctacctgccacatcgtcgaggcggcgagcagcttcaggttatctctgtgatgaatttcaaaggtgggtcgggtaagaccaccaccgccgcgcatctggcgcagtacctcgctatgcgcggatatcgagtcttggccattgatctcgatcctcaagcgagcctttctgcactctttgggagccaaccggagacggacgttggcccgaacgaaacgctctacggcgctataaggtatgatgatgagcaggtggcaatcgaacgagtcgtccgagggacttacattcccgacctccacctgattcctggtaatcttgagctgatggagtttgaacacgatacgccacgcgcgctgatgaaccgcaaagagggcgacacgctcttttatggtcgcatcagccaagtaattgaagatatcgcggataactatgacgtcgtggtcatcgactgccctccccagcttgggtatctcacgctatccgcattgactgcggcgacgtccattcttgtcacggtccatccgcagatgctggatgtgatgtcgatgaaccagtttctggcaatgacatcgaaccttttgcgtgaaatcgagaatgctggcgccaagttcaagtttaattggatgcgctatctgataacccgtttcgaaccgagcgacggaccacagaaccaaatggtaggttatctgcggtcgatttttggcgaaaatgtcctcaattttccgatgcttaaaaccaccgcggtttcggacgctggcctgacaaaccagactctattcgaagtggagcgtggcctgttcacgcgctcgacctatgatcgagccttggaggcgatgaacgccgtcaacgacgagatcgaaacactgatcaaaaaagcatggggtaggcccacatgagccggaagcacatccttggcgtctcaactgacgcccctgagacgtcgcccgccgacaataggacggcaaagaaccgctccatgccgctcctcggcgtaacaaggaaggagcgcgatccggcaacgaagctcacagcgaacattggtaacgcactgcgagagcaaaacgatcgtcttagccgtgccgaagagatcgagcggcgtctcgctgaaggtcaggcagtgatagagttggatgcctcgtcaatagaaccgtctttcgtgcaggatcgtatgcgaggggacattgacgggctccttacttcgatccgggaacaaggacagcaagtcccaatccttgtgcgaccgcatccgagccagccgggccgatatcaggttgccttcggccaccgccggctacgcgccgtttcagaactcggacttccggtcagagcggtcgttcgcgaactgacggacgagcaagtggtcgtagcacagggtcaggaaaacaatgagcgcgaagatcttaccttcatcgaaaaggcgcgcttcgcacatcgcctgaacaggcagttttctcgagagattgtcatcgccgcgatgtcgatcgacaagagcaatttgtccaagatgcttctgctcgttgacgccctcccctctgaactgaccgatgctattggtgccgctcctggtgttggacggccgagttggcaacaacttgccgagctgattgagaaagtttcttcaccggccgacgtggctaaatatgctatgtcggaggaagttcaagcgctgccatcggcagaacgattcaaggcggtgatcgctagtctgaagcccagtcgggttgcgcgtggacttcccgaggtcatggccaccccagacggcaccagaattgcacaggtgacgcagagcaaggccaaactggaaatcacgattgacaggaaggcgacgcccgattttgcgaccttcgtgctcgatcatgtgccagcgctgtatcaagcgtaccacgctgagaaccaacggaaacggggagagtaaaccgcaaaagaaaagagccccctcaacgtcgccgtcgcggaagcccttctgtctctctagcgcgaacagaatcgcatttcctcgaatcctcgtcaagagtttttagcgccgttttggtgagctgatttcctttgcctgctgaaaggtgaaagatgatgcagacaggaagtgtaacgacgccattcgggcggcggccaatgacgcttgcgcttgtgcggcgccagacggcgctggccgatatcaaacaaggcaagacagcggacaagtggaaggtctttagagacgcgtccgcggctatggaactacttggaatccagtccaacagtcttgccgtccttgatgcgctattgagctttcacccggaaacggagttgcgtcaggaggcacagctgatcgtcttcccgtcgaatgctcagcttgcccttcgggcgcatgggatggctggcgcgactttgcgtaggcacatcgccatgctcgtggagtcaggcttgatcgtccggaaggatagcgccaacggaaagcgttacgctcgtaaggatggcgctggtcagatcgagcgcgcgtttggcttcgatttgtctccgcttctcgcgcggtcggaagagctagcgatgatggcacagcaggtgatggccgatcgagcagcattcaggatggccaaagaaagtctgacgatttgccgacgggacgttcggaagctaattacggcagctatggaagagggagcggagggcgactggcaagctgtcgaggaagtctatgtggaacttgtgggtagaattccacgcgccccgacgcttgctgatgtagagtcaattctcgaagagatgtggatgctccaggaagagataatcaaccggttggaaattagagacaattcagaaaataatagcaccaatgctgcccagagcgagcagcacatacagaattcaaaacccgaatccgttaatgaacttgaacctcgctctgaaaaggagcagggcgctaagccgagtgaaatagaccgggcaaggagcgagccgataaaagcgttccccctcgggatgatcctgaaagcatgcccgaccattggcaactatgggccgagcggtgcggttgctagctggcgtgacctcatgtcggctgcggtggtggttcggtctatgctgggggtcagcccgtcggcttaccaagacgcgtgtgaggcaatgggaccggagaatgcggcagcagcgatggcgtgcattttggagcgagcgaacttcatcaattcgcccgggggctatctccgagatctgacacggcggagcgagcttgggaagttttcacttggcccgatgataatggcgctcttgaaggctagcgggcaggggacgttgcggtttggctagaattagcgagtatggagcaggatggtctgtggtcagctgaccacagacctaataggttgaaaacatgagcgttttttggatgatcgacagaccatccgattcccggagtaccaagcgtgctctgatgggagcgataacattactcaacaagcacgaaggccccatgccgatcgttgatcgtgaaggagagcctgctctacatgcggcggtattttgccggccgaggcatgtagtcgcggagcactgcctatttactgccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaaccctgcaggccggccgtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaaccggccggcctgcaggtcgaggaggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctaaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtaccgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaag

SEQ ID NO: 49 - DNA, 41039 bp, Artificial
  Vector 4
ggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagttttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatcctgaggaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgaatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcaagcttggcgcgccggtcacccggtccgggcctagaaggccacccgggggctcggcgttaggcttttagtccgctaggtggctagaccgaggttaggacgctagttcactaggggcctagtggtgttttaaggatatccccccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaaggttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccaagcttggcgcgccggtcacccggtccgggcctagaaggccacccggggcgacttattgaactagtctagggcgcggctaacaacctagcttagattgccttgtctaaacccttaggctaacgcgccacgatatccccacccagcaggcagcagcagtatccaactagtcatgtatccagcctaaattgaaaagtcagatcatgtgtaacatggccctcaatatttcgatgttgccttgtggaaaaaatagctggtattggtactgtgttttttactccttccagctaccgacgttcagtgttagtgcacaaaatgttcatccatggtagtttgtctacattgcagtcatgtaaagttaaacattcacgatttctgtacttttgcatgtgtaactaaatgaaatggtgtgttacattcattccttcaatcaaataatccatagaaacaaactggtttgtaactattgtaactagtcgctagtgtccatggtattttcgattgtggaacataattagtttaatctgcttcagtataacttaagccggctttatcctgtgtatgcatcagcttcgctccattgaacatccaaacatcagtataagcattttgtggcgactaatcatccggatatcggaccgattaaactttaattcggtccgataacttcgtatagcatacattatacgaagttatatgcatacgcgtcttaagtcgatcgctatcaactttgtatagaaaagttgggccgaattcgagctcggtacggccagaatggcccggaccgggttaccgaattcgagctcggtaccctgggatccggtgcgggcctcttcgctattacgccagctggcgaaagggggatgtgctgcaaggcgattaagttgggtaacgccagggttttcccagtcacgacgttgtaaaacgacggccagtgccaagctcagatcagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgctgatccgatatcgatgggccctggccgaagcttggtcacccggtccgggcctagaaggccagcttcaagtttgtacaaaaaagcaggctccggccagaatggcccggaccgggttaccgaattcgagctcggtaccctgggatccgatatcgatgggccctggccgaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataatgaggatcgaggatggttttagagctagaaatagcaagttaaaataaggctagtccgttatcaacttgaaaaagtggcaccgagtcggtgctttttttttgcggccgcgaattcctgcagggccctcttgtcggaccagttgcccaccacgttggtgaggggcacccagctttcttgtacaaagtggccgttaacggatcggccagaatggcccggaccgggttaccgcataatgaggatcgaggatgaggcggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgaggatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccatgtctgagccgagcccgatcgctgatccttacgcgtacctcaacattgtcaacaaccccgacgggtccatcaccagggacctctctaactttccctgcaccgcagctacacctgacccctcgcctctgaatcccgcagtgtccaaggacctgcccgtgaaccagttgaagtcgacctggttgcggctgtaccttcctagcagcgcagtcaacgagggcaacgtttcctcccagaagctcccgatcgtggtctactaccacggaggcggattcatcctctgcagcgtcgacatgcagttgttccacgacttctgctcggaggtggcgagggacctcaacgcaatcgtcgtgagcccaagctacagactggcccccgaacacaggctgccggctgcctacgacgatggagtcgaagcattggactggatcaagacgtcggacgacgagtggatcaagtcccacgcagacttctccaacgtgttcctcatgggaacctccgccggaggaaacttggcgtacaacgttggcctgaggagcgtcgactccgtctcggatctgtctcctctccagatacgcggcttgatcctccaccacccgttctttggaggcgaggagaggtcggagtccgagatcaggctgatgaacgatcaggtgtgcccccccattgtcacggacgtgatgtgggatctgagcctcccggttggagtggacagggaccacgagtactccaacccgaccgtcggagacggttcggagaagctcgagaagatcgggaggttgcgctggaaggtgatgatgataggcggcgaggacgacccgatgatcgacctccagaaggacgtggccaagctgatgaagaagaagggcgttgaggtcgtcgagcactataccggaggccacgttcacggtgccgaaatccgcgacccctcaaagagaaagacgctgttcctcagcatcaagaacttcatcttctcggtcctctagggtaccgttaacagatctactaactatctatactgtaataatgttgtatagccgccggatagctagctagtttagtcattcagcggcgatgggtaataataaagtgtcatccatccatcaccatgcgtggcaacgtgagcaatgacctgattgaacaaattgaaatgaaaagaagaaatatgttatatgtcaacgagatttcctcataatgccactgacgacgtgtgtccaagaaatgtatcagtgatacgtatattcacaatttttttatgacttatactcacaatttgtttttttactacttatactcacaatttgttgtgcgtaccataacaatttcgatcgaatatatatcagaaagttgacgaaagtaagctcactcaaaaagttaaatgggctgcggaagctgcgtcaggcccaagttttggctattctatccggtatccacgattttgatggctgagggacatatgttcgcttatgaggagcaatcattgttcaagacatgatgcaaagctagaaaactttgattgtggccgtccttgtgaagtttaggccggggggaacttcatgaaccctatcgaagcttaattagttcttttttgttgttagccatgtttgtattgtagttaaggtgaacaacatgacgccgcacccgcgatctcagggctcgtccccacacaggagggcacgtcgtcgtcttcgccgccgagcatcagagattcagagcacatacacgcacatctcaagcaaacggagtagtacgtcctactcctacgtacatacctagccgacgacctttatgtgcacaccaccactgctctgctgcccggcctctccgtcgtccgttcatcaccagcttgtcgggtccttcagtttgcatgcgtcgctccgaagtcaacgcataatgaggatcgaggatgaggggtcacccggtccgggcctagaaggccagcttcggccgccccgggcaactttattatacaaagttgatcacgtgagagtctaaaaacggcccctaactaacgcttagttgcccgctagattagtcccccgttagtgcctagttagacacacgacgaactaggggctataaggatttaaatcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagggcgatccgatatcgatgggccctggccgaagcttggtcacccggtccgggcctagaaggccgcttgcatgcctgcaggtcgactctagaggatctgcaccggacactgtctggtggcataccagacagtccggtgtgccagatcagggcacccttcggttcctttgctcctttgcttttgaaccctaactttgatcgtttattggtttgtgttgaacctttatgcacctgtggaatatataatctagaacaaactagttagtccaatcatttgtgttgggcattcaaccaccaaaattatttataggaaaaggttaaaccttatttccctttcaatctccccctttttggtgattgatgccaacacaaaccaaagaaaatatataagtgcagaattgaactagtttgcataaggtaagtgcataggttacttagaattaaatcaatttatacttttacttgatatgcatggttgctttcttttattttaacattttggaccacatttgcaccacttgttttgttttttgcaaatctttttggaaattctttttcaaagtcttttgcaaatagtcaaaggtatatgaataagattgtaagaagcattttcaagatttgaaatttctccccctgtttcaaatgcttttcctttgactaaacaaaactccccctgaataaaattctcctcttagctttcaagagggttttaaatagatatcaattggaaatatatttagatgctaattttgaaaatataccaattgaaaatcaacataccaatttgaaattaaacataccaatttaaaaaatttcaaaaagtggtggtgcggtccttttgctttgggcttaatatttctccccctttggcattaatcgccaaaaacggagactttgtgagccatttatactttctccccattggtaaatgaaatatgagtgaaagattataccaaatttggacagtgatgcggagtgacggcgaaggataaacgataccgttagagtggagtggaagccttgtcttcgccgaagactccatttccctttcaatctacgacttagcatagaaatacacttgaaaacacattagtcgtagccacgaaagagatatgatcaaaggtatacaaatgagctatgtgtgtaatgtttcaatcaaagtttcgagaatcaagaatatttagctcattcctaagtttgctaaaggttttatcatctaatggtttggtaaagatatcgactaattgttctttggtgctaacataagcaatctcgatatcacccctttgttggtgatccctcaaaaagtgataccgaatgtctatgtgcttagtgcggctgtgttcaacgggattatccgccatgcagatagcactctcattgtcacataggagagggactttgctcaatttgtagccatagtccctaaggttttgcctcatccaaagtaattgcacacaacaatgtcctgcggcaatatacttggcttcggcggtagaaagagctattgagttttgtttctttgaagtccaagacaccagggatctccctagaaactgacaagtccctgatgtgctcttcctatcaattttacaccctgcccaatcggcatctgaatatcctattaaatcaaaggtggatcccttggggtaccaaagaccaaatttaggagtgtaaactaaatatctcatgattcttttcacggccctaaggtgaacttccttaggatcggcttggaatcttgcacacatgcatatagaaagcatactatctggtcgagatgcacataaatagagtaaagatcctatcatcgaccggtataccttttggtctacggatttacctcccgtgtcgaggtcgagatgcccattagttcccatgggtgtcctgatgggcttggcatccttcattccaaacttgttgagtatgtcttgaatgtactttgtttggctgatgaaggtgccatcttggagttgcttgacttgaaatcctagaaaatatttcaacttccccatcatagacatctcgaatttcggaatcatgatcctactaaactcttcacaagtagatttgttagtagacccaaatataatatcatcaacataaatttggcatacaaacaaaacttttgaaatggttttagtaaagagagtaggatcggctttactgactctgaagccattagtgataagaaaatctcttaggcattcataccatgctgttggggcttgcttgagcccataaagcgcctttgagagtttataaacatggttagggtactcactatcttcaaagccgagaggttgctcaacatagacctattcaccccatttgatcacttttttggtccttcaggatctaatagttatgtataatttagagtctcttgtttaatggccagatatttctaattaatctaagaatttatgatattttttaattttttatcatgtctgatgagaattaacataaaggctcaattgggtcctgaattaataatagagtgaaaattaatccagaggctctattagaaccttcaattagtaataccaagatatatataagatagtagagtatagtttaaatgttggcattgttcattctttcttttgttatttaatttatgctttccacggtggttagtggttacttctgaagggtccaaataatgcatgaagagtttgaggacaagaagtctgccctaaaaatagcgatgcaaaggcatggtgtccaagccatacatatagcgcactaattttatcagcagaacaatggtatttataggtcctagtgcccaggcaacaagagacacgaataaagcatcgatcacgacaccatggcggcgacaatggcagtgacgacgatggtgacgaggagcaaggagagctggtcgtcattgcaggtcccggcggtggcattcccttggaagccacgaggtggcaagaccggcggcctcgagttccctcgccgggcgatgttcgccagcgtcggcctcaacgtgtgcccgggcgtcccggcggggcgcgacccgcgggagcccgatcccaaggtcgtccgggcggcctgcggcctggtccaggcacaagtcctcttccaggggtttaactgggagtcgtgcaagcagcagggaggctggtacaacaggctcaaggcccaggtcgacgacatcgccaaggccggcgtcacgcacgtctggctgcctccaccctcgcactccgtctcgccacaaggctacatgccaggccgcctatacgacctggacgcgtccaagtacggcacggcggcggagctcaagtccctgatagcggcgttccacggcaggggcgtgcagtgcgtggcggacatcgtcatcaaccaccggtgcgcggaaaagaaggacgcgcgcggcgtgtactgcatcttcgagggcgggactcccgacgaccgcctggactggggccccgggatgatctgcagcgacgacacgcagtactcggacgggacggggcaccgcgacacgggcgaggggttcgcggcggcgcccgacatcgaccacctcaacccgcgcgtgcagcgggagctctccgcctggctcaactggctcaggtccgacgccgtggggttcgacggctggcgcctcgacttcgccaagggctactcgccggccgtcgccagaatgtacgtggagagcacggggccgccgagcttcgtcgtcgcggagatatggaactcgctgagctacagcggggacggcaagccggcgcccaaccaggaccagtgccggcaggagctgctggactggacgcgggccgtcggcgggcccgccatggcgttcgacttccccaccaagggcctgctgcaggcgggcgtgcagggggagctgtggcggctgcgcgacagctccggcaacgcggccggcctgatcgggtgggcgcccgagaaggccgtcaccttcgtcgacaaccatgacaccgggtcgacgcagaagctctggccgttcccatccgacaaggtcatgcagggctacgcctacatcctcacccatccaggagtcccctgcattttctacgaccacatgttcgactggaacctgaagcaggagatatccacgctgtctgccatcagggcgcggaacggcatccgcgccgggagcaagctgcggatcctcgtggcggacgcggacgcgtacgtggccgtcgtcgacgagaaggtcatggtgaagatcgggacaaggtacggcgtgagcagcgtggtcccgtcggatttccacccggcggcgcacggcaaggactactgcgtctgggagaaagcgagcctccgcgtcccggcggggcgccacctctagcagctcagattgctcagtcttgtgctgcattgcaaacacagcagcacgacactgcataacgtcttttccttgagatctgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagctactttagactgtgttcggcgttccccctaaatttctccccctatatctcactcacttgtcacatcagcgttctctttcccctatatctccacgtcgatgattccgatgacttcgtaggttcctagctcaagccgctcgtgtccaagcgtcacttacgattagctaatgattacggcatctaggaccgactagctaactaactagtacgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgggcccaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgtgggcgttaaccttctgttaacctaaaagctcttgcccaaacagcagaatcggcgctaattgccagcggcggaacttttccagtttcgcgaaaaatatcgccactggcaaggaatgggtttgagatggcgaagtctgtcctaaaagcagcgcctgtagttgtagggttgacggccttgatggagcgtcatgccgatgccctctcgagccaacttcaagcacatcatcttaaggttttcccgccgcattccgagaagggcattcgaacattcgggccatcggaggcgtccaagctgctcggcgttggcgagtcatatttacggcagaccgcgtctgagatgccagagttgaatgttagcatgagcccgggtggcaggcgaatgttctcaattgaagatatccatgcgattcggaagtatatggatcaggtcggccgcgggaaccggcgctacctgccacatcgtcgaggcggcgagcagcttcaggttatctctgtgatgaatttcaaaggtgggtcgggtaagaccaccaccgccgcgcatctggcgcagtacctcgctatgcgcggatatcgagtcttggccattgatctcgatcctcaagcgagcctttctgcactctttgggagccaaccggagacggacgttggcccgaacgaaacgctctacggcgctataaggtatgatgatgagcaggtggcaatcgaacgagtcgtccgagggacttacattcccgacctccacctgattcctggtaatcttgagctgatggagtttgaacacgatacgccacgcgcgctgatgaaccgcaaagagggcgacacgctcttttatggtcgcatcagccaagtaattgaagatatcgcggataactatgacgtcgtggtcatcgactgccctccccagcttgggtatctcacgctatccgcattgactgcggcgacgtccattcttgtcacggtccatccgcagatgctggatgtgatgtcgatgaaccagtttctggcaatgacatcgaaccttttgcgtgaaatcgagaatgctggcgccaagttcaagtttaattggatgcgctatctgataacccgtttcgaaccgagcgacggaccacagaaccaaatggtaggttatctgcggtcgatttttggcgaaaatgtcctcaattttccgatgcttaaaaccaccgcggtttcggacgctggcctgacaaaccagactctattcgaagtggagcgtggcctgttcacgcgctcgacctatgatcgagccttggaggcgatgaacgccgtcaacgacgagatcgaaacactgatcaaaaaagcatggggtaggcccacatgagccggaagcacatccttggcgtctcaactgacgcccctgagacgtcgcccgccgacaataggacggcaaagaaccgctccatgccgctcctcggcgtaacaaggaaggagcgcgatccggcaacgaagctcacagcgaacattggtaacgcactgcgagagcaaaacgatcgtcttagccgtgccgaagagatcgagcggcgtctcgctgaaggtcaggcagtgatagagttggatgcctcgtcaatagaaccgtctttcgtgcaggatcgtatgcgaggggacattgacgggctccttacttcgatccgggaacaaggacagcaagtcccaatccttgtgcgaccgcatccgagccagccgggccgatatcaggttgccttcggccaccgccggctacgcgccgtttcagaactcggacttccggtcagagcggtcgttcgcgaactgacggacgagcaagtggtcgtagcacagggtcaggaaaacaatgagcgcgaagatcttaccttcatcgaaaaggcgcgcttcgcacatcgcctgaacaggcagttttctcgagagattgtcatcgccgcgatgtcgatcgacaagagcaatttgtccaagatgcttctgctcgttgacgccctcccctctgaactgaccgatgctattggtgccgctcctggtgttggacggccgagttggcaacaacttgccgagctgattgagaaagtttcttcaccggccgacgtggctaaatatgctatgtcggaggaagttcaagcgctgccatcggcagaacgattcaaggcggtgatcgctagtctgaagcccagtcgggttgcgcgtggacttcccgaggtcatggccaccccagacggcaccagaattgcacaggtgacgcagagcaaggccaaactggaaatcacgattgacaggaaggcgacgcccgattttgcgaccttcgtgctcgatcatgtgccagcgctgtatcaagcgtaccacgctgagaaccaacggaaacggggagagtaaaccgcaaaagaaaagagccccctcaacgtcgccgtcgcggaagcccttctgtctctctagcgcgaacagaatcgcatttcctcgaatcctcgtcaagagtttttagcgccgttttggtgagctgatttcctttgcctgctgaaaggtgaaagatgatgcagacaggaagtgtaacgacgccattcgggcggcggccaatgacgcttgcgcttgtgcggcgccagacggcgctggccgatatcaaacaaggcaagacagcggacaagtggaaggtctttagagacgcgtccgcggctatggaactacttggaatccagtccaacagtcttgccgtccttgatgcgctattgagctttcacccggaaacggagttgcgtcaggaggcacagctgatcgtcttcccgtcgaatgctcagcttgcccttcgggcgcatgggatggctggcgcgactttgcgtaggcacatcgccatgctcgtggagtcaggcttgatcgtccggaaggatagcgccaacggaaagcgttacgctcgtaaggatggcgctggtcagatcgagcgcgcgtttggcttcgatttgtctccgcttctcgcgcggtcggaagagctagcgatgatggcacagcaggtgatggccgatcgagcagcattcaggatggccaaagaaagtctgacgatttgccgacgggacgttcggaagctaattacggcagctatggaagagggagcggagggcgactggcaagctgtcgaggaagtctatgtggaacttgtgggtagaattccacgcgccccgacgcttgctgatgtagagtcaattctcgaagagatgtggatgctccaggaagagataatcaaccggttggaaattagagacaattcagaaaataatagcaccaatgctgcccagagcgagcagcacatacagaattcaaaacccgaatccgttaatgaacttgaacctcgctctgaaaaggagcagggcgctaagccgagtgaaatagaccgggcaaggagcgagccgataaaagcgttccccctcgggatgatcctgaaagcatgcccgaccattggcaactatgggccgagcggtgcggttgctagctggcgtgacctcatgtcggctgcggtggtggttcggtctatgctgggggtcagcccgtcggcttaccaagacgcgtgtgaggcaatgggaccggagaatgcggcagcagcgatggcgtgcattttggagcgagcgaacttcatcaattcgcccgggggctatctccgagatctgacacggcggagcgagcttgggaagttttcacttggcccgatgataatggcgctcttgaaggctagcgggcaggggacgttgcggtttggctagaattagcgagtatggagcaggatggtctgtggtcagctgaccacagacctaataggttgaaaacatgagcgttttttggatgatcgacagaccatccgattcccggagtaccaagcgtgctctgatgggagcgataacattactcaacaagcacgaaggccccatgccgatcgttgatcgtgaaggagagcctgctctacatgcggcggtattttgccggccgaggcatgtagtcgcggagcactgcctatttactgccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaaccctgcaggccggccgtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaaccggccggcctgcaggtcgaggaggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctaaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtaccgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaag

SEQ ID NO: 50 - DNA, 36802 bp, Artificial
  Vector 5
gtttacccgccaatatatcctgtcaaacactgatagttttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatcctgaggaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgaatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcaagcttggcgcgccggtcacccggtccgggcctagaaggccacccgggggctcggcgttaggcttttagtccgctaggtggctagaccgaggttaggacgctagttcactaggggcctagtggtgttttaaggatatccccccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaaggttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccaagcttggcgcgccggtcacccggtccgggcctagaaggccacccggggcgacttattgaactagtctagggcgcggctaacaacctagcttagattgccttgtctaaacccttaggctaacgcgccacgatatccccacccagcaggcagcagcagtatccaactagtcatgtatccagcctaaattgaaaagtcagatcatgtgtaacatggccctcaatatttcgatgttgccttgtggaaaaaatagctggtattggtactgtgttttttactccttccagctaccgacgttcagtgttagtgcacaaaatgttcatccatggtagtttgtctacattgcagtcatgtaaagttaaacattcacgatttctgtacttttgcatgtgtaactaaatgaaatggtgtgttacattcattccttcaatcaaataatccatagaaacaaactggtttgtaactattgtaactagtcgctagtgtccatggtattttcgattgtggaacataattagtttaatctgcttcagtataacttaagccggctttatcctgtgtatgcatcagcttcgctccattgaacatccaaacatcagtataagcattttgtggcgactaatcatccggatatcggaccgattaaactttaattcggtccgataacttcgtatagcatacattatacgaagttatatgcatacgcgtcttaagtcgatcgctatcaactttgtatagaaaagttgggccgaattcgagctcggtacggccagaatggcccggaccgggttaccgaattcgagctcggtaccctgggatccggtgcgggcctcttcgctattacgccagctggcgaaagggggatgtgctgcaaggcgattaagttgggtaacgccagggttttcccagtcacgacgttgtaaaacgacggccagtgccaagctcagatcagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgctgatccgatatcgatgggccctggccgaagcttggtcacccggtccgggcctagaaggccagcttcaagtttgtacaaaaaagcaggctccggccagaatggcccggaccgggttaccgaattcgagctcggtaccctgggatccgatatcgatgggccctggccgaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataatgaggatcgaggatggttttagagctagaaatagcaagttaaaataaggctagtccgttatcaacttgaaaaagtggcaccgagtcggtgctttttttttgcggccgcgaattcctgcagggccctcttgtcggaccagttgcccaccacgttggtgaggggcacccagctttcttgtacaaagtggccgttaacggatcggccagaatggcccggaccgggttaccgcataatgaggatcgaggatgaggactaatgaaaatcacatctggatcctgaaatcggcgtcgtaacctacaaggccacggactggattagatagtggtccatggtgcataatgagggtagtggatgatgagcaatcattgttcaagacatgatgcaaagctagaaaactttgattgtggccgtcctaattgtgaagtttaggccggggggaacttcatgaaccctacctcatcctcgatcctcattatgccctgcagggccctcttgtcggaccagttgcccaccacgttggtgaggggcaactttattatacaaagttgatcacgtgagagtctaaaaacggcccctaactaacgcttagttgcccgctagattagtcccccgttagtgcctagttagacacacgacgaactaggggctataaggatttaaatcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagggcgatccgatatcgatgggccctggccgaagcttggtcacccggtccgggcctagaaggccgcttgcatgcctgcaggtcgactctagaggatctgcaccggacactgtctggtggcataccagacagtccggtgtgccagatcagggcacccttcggttcctttgctcctttgcttttgaaccctaactttgatcgtttattggtttgtgttgaacctttatgcacctgtggaatatataatctagaacaaactagttagtccaatcatttgtgttgggcattcaaccaccaaaattatttataggaaaaggttaaaccttatttccctttcaatctccccctttttggtgattgatgccaacacaaaccaaagaaaatatataagtgcagaattgaactagtttgcataaggtaagtgcataggttacttagaattaaatcaatttatacttttacttgatatgcatggttgctttcttttattttaacattttggaccacatttgcaccacttgttttgttttttgcaaatctttttggaaattctttttcaaagtcttttgcaaatagtcaaaggtatatgaataagattgtaagaagcattttcaagatttgaaatttctccccctgtttcaaatgcttttcctttgactaaacaaaactccccctgaataaaattctcctcttagctttcaagagggttttaaatagatatcaattggaaatatatttagatgctaattttgaaaatataccaattgaaaatcaacataccaatttgaaattaaacataccaatttaaaaaatttcaaaaagtggtggtgcggtccttttgctttgggcttaatatttctccccctttggcattaatcgccaaaaacggagactttgtgagccatttatactttctccccattggtaaatgaaatatgagtgaaagattataccaaatttggacagtgatgcggagtgacggcgaaggataaacgataccgttagagtggagtggaagccttgtcttcgccgaagactccatttccctttcaatctacgacttagcatagaaatacacttgaaaacacattagtcgtagccacgaaagagatatgatcaaaggtatacaaatgagctatgtgtgtaatgtttcaatcaaagtttcgagaatcaagaatatttagctcattcctaagtttgctaaaggttttatcatctaatggtttggtaaagatatcgactaattgttctttggtgctaacataagcaatctcgatatcacccctttgttggtgatccctcaaaaagtgataccgaatgtctatgtgcttagtgcggctgtgttcaacgggattatccgccatgcagatagcactctcattgtcacataggagagggactttgctcaatttgtagccatagtccctaaggttttgcctcatccaaagtaattgcacacaacaatgtcctgcggcaatatacttggcttcggcggtagaaagagctattgagttttgtttctttgaagtccaagacaccagggatctccctagaaactgacaagtccctgatgtgctcttcctatcaattttacaccctgcccaatcggcatctgaatatcctattaaatcaaaggtggatcccttggggtaccaaagaccaaatttaggagtgtaaactaaatatctcatgattcttttcacggccctaaggtgaacttccttaggatcggcttggaatcttgcacacatgcatatagaaagcatactatctggtcgagatgcacataaatagagtaaagatcctatcatcgaccggtataccttttggtctacggatttacctcccgtgtcgaggtcgagatgcccattagttcccatgggtgtcctgatgggcttggcatccttcattccaaacttgttgagtatgtcttgaatgtactttgtttggctgatgaaggtgccatcttggagttgcttgacttgaaatcctagaaaatatttcaacttccccatcatagacatctcgaatttcggaatcatgatcctactaaactcttcacaagtagatttgttagtagacccaaatataatatcatcaacataaatttggcatacaaacaaaacttttgaaatggttttagtaaagagagtaggatcggctttactgactctgaagccattagtgataagaaaatctcttaggcattcataccatgctgttggggcttgcttgagcccataaagcgcctttgagagtttataaacatggttagggtactcactatcttcaaagccgagaggttgctcaacatagacctattcaccccatttgatcacttttttggtccttcaggatctaatagttatgtataatttagagtctcttgtttaatggccagatatttctaattaatctaagaatttatgatattttttaattttttatcatgtctgatgagaattaacataaaggctcaattgggtcctgaattaataatagagtgaaaattaatccagaggctctattagaaccttcaattagtaataccaagatatatataagatagtagagtatagtttaaatgttggcattgttcattctttcttttgttatttaatttatgctttccacggtggttagtggttacttctgaagggtccaaataatgcatgaagagtttgaggacaagaagtctgccctaaaaatagcgatgcaaaggcatggtgtccaagccatacatatagcgcactaattttatcagcagaacaatggtatttataggtcctagtgcccaggcaacaagagacacgaataaagcatcgatcacgacaccatggcggcgacaatggcagtgacgacgatggtgacgaggagcaaggagagctggtcgtcattgcaggtcccggcggtggcattcccttggaagccacgaggtggcaagaccggcggcctcgagttccctcgccgggcgatgttcgccagcgtcggcctcaacgtgtgcccgggcgtcccggcggggcgcgacccgcgggagcccgatcccaaggtcgtccgggcggcctgcggcctggtccaggcacaagtcctcttccaggggtttaactgggagtcgtgcaagcagcagggaggctggtacaacaggctcaaggcccaggtcgacgacatcgccaaggccggcgtcacgcacgtctggctgcctccaccctcgcactccgtctcgccacaaggctacatgccaggccgcctatacgacctggacgcgtccaagtacggcacggcggcggagctcaagtccctgatagcggcgttccacggcaggggcgtgcagtgcgtggcggacatcgtcatcaaccaccggtgcgcggaaaagaaggacgcgcgcggcgtgtactgcatcttcgagggcgggactcccgacgaccgcctggactggggccccgggatgatctgcagcgacgacacgcagtactcggacgggacggggcaccgcgacacgggcgaggggttcgcggcggcgcccgacatcgaccacctcaacccgcgcgtgcagcgggagctctccgcctggctcaactggctcaggtccgacgccgtggggttcgacggctggcgcctcgacttcgccaagggctactcgccggccgtcgccagaatgtacgtggagagcacggggccgccgagcttcgtcgtcgcggagatatggaactcgctgagctacagcggggacggcaagccggcgcccaaccaggaccagtgccggcaggagctgctggactggacgcgggccgtcggcgggcccgccatggcgttcgacttccccaccaagggcctgctgcaggcgggcgtgcagggggagctgtggcggctgcgcgacagctccggcaacgcggccggcctgatcgggtgggcgcccgagaaggccgtcaccttcgtcgacaaccatgacaccgggtcgacgcagaagctctggccgttcccatccgacaaggtcatgcagggctacgcctacatcctcacccatccaggagtcccctgcattttctacgaccacatgttcgactggaacctgaagcaggagatatccacgctgtctgccatcagggcgcggaacggcatccgcgccgggagcaagctgcggatcctcgtggcggacgcggacgcgtacgtggccgtcgtcgacgagaaggtcatggtgaagatcgggacaaggtacggcgtgagcagcgtggtcccgtcggatttccacccggcggcgcacggcaaggactactgcgtctgggagaaagcgagcctccgcgtcccggcggggcgccacctctagcagctcagattgctcagtcttgtgctgcattgcaaacacagcagcacgacactgcataacgtcttttccttgagatctgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagctactttagactgtgttcggcgttccccctaaatttctccccctatatctcactcacttgtcacatcagcgttctctttcccctatatctccacgtcgatgattccgatgacttcgtaggttcctagctcaagccgctcgtgtccaagcgtcacttacgattagctaatgattacggcatctaggaccgactagctaactaactagtacgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgggcccaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgtgggcgttaaccttctgttaacctaaaagctcttgcccaaacagcagaatcggcgctaattgccagcggcggaacttttccagtttcgcgaaaaatatcgccactggcaaggaatgggtttgagatggcgaagtctgtcctaaaagcagcgcctgtagttgtagggttgacggccttgatggagcgtcatgccgatgccctctcgagccaacttcaagcacatcatcttaaggttttcccgccgcattccgagaagggcattcgaacattcgggccatcggaggcgtccaagctgctcggcgttggcgagtcatatttacggcagaccgcgtctgagatgccagagttgaatgttagcatgagcccgggtggcaggcgaatgttctcaattgaagatatccatgcgattcggaagtatatggatcaggtcggccgcgggaaccggcgctacctgccacatcgtcgaggcggcgagcagcttcaggttatctctgtgatgaatttcaaaggtgggtcgggtaagaccaccaccgccgcgcatctggcgcagtacctcgctatgcgcggatatcgagtcttggccattgatctcgatcctcaagcgagcctttctgcactctttgggagccaaccggagacggacgttggcccgaacgaaacgctctacggcgctataaggtatgatgatgagcaggtggcaatcgaacgagtcgtccgagggacttacattcccgacctccacctgattcctggtaatcttgagctgatggagtttgaacacgatacgccacgcgcgctgatgaaccgcaaagagggcgacacgctcttttatggtcgcatcagccaagtaattgaagatatcgcggataactatgacgtcgtggtcatcgactgccctccccagcttgggtatctcacgctatccgcattgactgcggcgacgtccattcttgtcacggtccatccgcagatgctggatgtgatgtcgatgaaccagtttctggcaatgacatcgaaccttttgcgtgaaatcgagaatgctggcgccaagttcaagtttaattggatgcgctatctgataacccgtttcgaaccgagcgacggaccacagaaccaaatggtaggttatctgcggtcgatttttggcgaaaatgtcctcaattttccgatgcttaaaaccaccgcggtttcggacgctggcctgacaaaccagactctattcgaagtggagcgtggcctgttcacgcgctcgacctatgatcgagccttggaggcgatgaacgccgtcaacgacgagatcgaaacactgatcaaaaaagcatggggtaggcccacatgagccggaagcacatccttggcgtctcaactgacgcccctgagacgtcgcccgccgacaataggacggcaaagaaccgctccatgccgctcctcggcgtaacaaggaaggagcgcgatccggcaacgaagctcacagcgaacattggtaacgcactgcgagagcaaaacgatcgtcttagccgtgccgaagagatcgagcggcgtctcgctgaaggtcaggcagtgatagagttggatgcctcgtcaatagaaccgtctttcgtgcaggatcgtatgcgaggggacattgacgggctccttacttcgatccgggaacaaggacagcaagtcccaatccttgtgcgaccgcatccgagccagccgggccgatatcaggttgccttcggccaccgccggctacgcgccgtttcagaactcggacttccggtcagagcggtcgttcgcgaactgacggacgagcaagtggtcgtagcacagggtcaggaaaacaatgagcgcgaagatcttaccttcatcgaaaaggcgcgcttcgcacatcgcctgaacaggcagttttctcgagagattgtcatcgccgcgatgtcgatcgacaagagcaatttgtccaagatgcttctgctcgttgacgccctcccctctgaactgaccgatgctattggtgccgctcctggtgttggacggccgagttggcaacaacttgccgagctgattgagaaagtttcttcaccggccgacgtggctaaatatgctatgtcggaggaagttcaagcgctgccatcggcagaacgattcaaggcggtgatcgctagtctgaagcccagtcgggttgcgcgtggacttcccgaggtcatggccaccccagacggcaccagaattgcacaggtgacgcagagcaaggccaaactggaaatcacgattgacaggaaggcgacgcccgattttgcgaccttcgtgctcgatcatgtgccagcgctgtatcaagcgtaccacgctgagaaccaacggaaacggggagagtaaaccgcaaaagaaaagagccccctcaacgtcgccgtcgcggaagcccttctgtctctctagcgcgaacagaatcgcatttcctcgaatcctcgtcaagagtttttagcgccgttttggtgagctgatttcctttgcctgctgaaaggtgaaagatgatgcagacaggaagtgtaacgacgccattcgggcggcggccaatgacgcttgcgcttgtgcggcgccagacggcgctggccgatatcaaacaaggcaagacagcggacaagtggaaggtctttagagacgcgtccgcggctatggaactacttggaatccagtccaacagtcttgccgtccttgatgcgctattgagctttcacccggaaacggagttgcgtcaggaggcacagctgatcgtcttcccgtcgaatgctcagcttgcccttcgggcgcatgggatggctggcgcgactttgcgtaggcacatcgccatgctcgtggagtcaggcttgatcgtccggaaggatagcgccaacggaaagcgttacgctcgtaaggatggcgctggtcagatcgagcgcgcgtttggcttcgatttgtctccgcttctcgcgcggtcggaagagctagcgatgatggcacagcaggtgatggccgatcgagcagcattcaggatggccaaagaaagtctgacgatttgccgacgggacgttcggaagctaattacggcagctatggaagagggagcggagggcgactggcaagctgtcgaggaagtctatgtggaacttgtgggtagaattccacgcgccccgacgcttgctgatgtagagtcaattctcgaagagatgtggatgctccaggaagagataatcaaccggttggaaattagagacaattcagaaaataatagcaccaatgctgcccagagcgagcagcacatacagaattcaaaacccgaatccgttaatgaacttgaacctcgctctgaaaaggagcagggcgctaagccgagtgaaatagaccgggcaaggagcgagccgataaaagcgttccccctcgggatgatcctgaaagcatgcccgaccattggcaactatgggccgagcggtgcggttgctagctggcgtgacctcatgtcggctgcggtggtggttcggtctatgctgggggtcagcccgtcggcttaccaagacgcgtgtgaggcaatgggaccggagaatgcggcagcagcgatggcgtgcattttggagcgagcgaacttcatcaattcgcccgggggctatctccgagatctgacacggcggagcgagcttgggaagttttcacttggcccgatgataatggcgctcttgaaggctagcgggcaggggacgttgcggtttggctagaattagcgagtatggagcaggatggtctgtggtcagctgaccacagacctaataggttgaaaacatgagcgttttttggatgatcgacagaccatccgattcccggagtaccaagcgtgctctgatgggagcgataacattactcaacaagcacgaaggccccatgccgatcgttgatcgtgaaggagagcctgctctacatgcggcggtattttgccggccgaggcatgtagtcgcggagcactgcctatttactgccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaaccctgcaggccggccgtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaaccggccggcctgcaggtcgaggaggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctaaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtaccgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttag

SEQ ID NO: 51 - DNA, 37102 bp, Artificial
  Vector 6
gtttacccgccaatatatcctgtcaaacactgatagttttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatcctgaggaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgaatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcaagcttggcgcgccggtcacccggtccgggcctagaaggccacccgggggctcggcgttaggcttttagtccgctaggtggctagaccgaggttaggacgctagttcactaggggcctagtggtgttttaaggatatccccccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaaggttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccaagcttggcgcgccggtcacccggtccgggcctagaaggccacccggggcgacttattgaactagtctagggcgcggctaacaacctagcttagattgccttgtctaaacccttaggctaacgcgccacgatatccccacccagcaggcagcagcagtatccaactagtcatgtatccagcctaaattgaaaagtcagatcatgtgtaacatggccctcaatatttcgatgttgccttgtggaaaaaatagctggtattggtactgtgttttttactccttccagctaccgacgttcagtgttagtgcacaaaatgttcatccatggtagtttgtctacattgcagtcatgtaaagttaaacattcacgatttctgtacttttgcatgtgtaactaaatgaaatggtgtgttacattcattccttcaatcaaataatccatagaaacaaactggtttgtaactattgtaactagtcgctagtgtccatggtattttcgattgtggaacataattagtttaatctgcttcagtataacttaagccggctttatcctgtgtatgcatcagcttcgctccattgaacatccaaacatcagtataagcattttgtggcgactaatcatccggatatcggaccgattaaactttaattcggtccgataacttcgtatagcatacattatacgaagttatatgcatacgcgtcttaagtcgatcgctatcaactttgtatagaaaagttgggccgaattcgagctcggtacggccagaatggcccggaccgggttaccgaattcgagctcggtaccctgggatccggtgcgggcctcttcgctattacgccagctggcgaaagggggatgtgctgcaaggcgattaagttgggtaacgccagggttttcccagtcacgacgttgtaaaacgacggccagtgccaagctcagatcagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgctgatccgatatcgatgggccctggccgaagcttggtcacccggtccgggcctagaaggccagcttcaagtttgtacaaaaaagcaggctccggccagaatggcccggaccgggttaccgaattcgagctcggtaccctgggatccgatatcgatgggccctggccgaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataatgaggatcgaggatggttttagagctagaaatagcaagttaaaataaggctagtccgttatcaacttgaaaaagtggcaccgagtcggtgctttttttttgcggccgcgaattcctgcagggccctcttgtcggaccagttgcccaccacgttggtgaggggcacccagctttcttgtacaaagtggccgttaacggatcggccagaatggcccggaccgggttaccgcataatgaggatcgaggatgagggtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgagggtagtggatgatgagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagccctcatcctcgatcctcattatgccctgcagggccctcttgtcggaccagttgcccaccacgttggtgaggggcaactttattatacaaagttgatcacgtgagagtctaaaaacggcccctaactaacgcttagttgcccgctagattagtcccccgttagtgcctagttagacacacgacgaactaggggctataaggatttaaatcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagggcgatccgatatcgatgggccctggccgaagcttggtcacccggtccgggcctagaaggccgcttgcatgcctgcaggtcgactctagaggatctgcaccggacactgtctggtggcataccagacagtccggtgtgccagatcagggcacccttcggttcctttgctcctttgcttttgaaccctaactttgatcgtttattggtttgtgttgaacctttatgcacctgtggaatatataatctagaacaaactagttagtccaatcatttgtgttgggcattcaaccaccaaaattatttataggaaaaggttaaaccttatttccctttcaatctccccctttttggtgattgatgccaacacaaaccaaagaaaatatataagtgcagaattgaactagtttgcataaggtaagtgcataggttacttagaattaaatcaatttatacttttacttgatatgcatggttgctttcttttattttaacattttggaccacatttgcaccacttgttttgttttttgcaaatctttttggaaattctttttcaaagtcttttgcaaatagtcaaaggtatatgaataagattgtaagaagcattttcaagatttgaaatttctccccctgtttcaaatgcttttcctttgactaaacaaaactccccctgaataaaattctcctcttagctttcaagagggttttaaatagatatcaattggaaatatatttagatgctaattttgaaaatataccaattgaaaatcaacataccaatttgaaattaaacataccaatttaaaaaatttcaaaaagtggtggtgcggtccttttgctttgggcttaatatttctccccctttggcattaatcgccaaaaacggagactttgtgagccatttatactttctccccattggtaaatgaaatatgagtgaaagattataccaaatttggacagtgatgcggagtgacggcgaaggataaacgataccgttagagtggagtggaagccttgtcttcgccgaagactccatttccctttcaatctacgacttagcatagaaatacacttgaaaacacattagtcgtagccacgaaagagatatgatcaaaggtatacaaatgagctatgtgtgtaatgtttcaatcaaagtttcgagaatcaagaatatttagctcattcctaagtttgctaaaggttttatcatctaatggtttggtaaagatatcgactaattgttctttggtgctaacataagcaatctcgatatcacccctttgttggtgatccctcaaaaagtgataccgaatgtctatgtgcttagtgcggctgtgttcaacgggattatccgccatgcagatagcactctcattgtcacataggagagggactttgctcaatttgtagccatagtccctaaggttttgcctcatccaaagtaattgcacacaacaatgtcctgcggcaatatacttggcttcggcggtagaaagagctattgagttttgtttctttgaagtccaagacaccagggatctccctagaaactgacaagtccctgatgtgctcttcctatcaattttacaccctgcccaatcggcatctgaatatcctattaaatcaaaggtggatcccttggggtaccaaagaccaaatttaggagtgtaaactaaatatctcatgattcttttcacggccctaaggtgaacttccttaggatcggcttggaatcttgcacacatgcatatagaaagcatactatctggtcgagatgcacataaatagagtaaagatcctatcatcgaccggtataccttttggtctacggatttacctcccgtgtcgaggtcgagatgcccattagttcccatgggtgtcctgatgggcttggcatccttcattccaaacttgttgagtatgtcttgaatgtactttgtttggctgatgaaggtgccatcttggagttgcttgacttgaaatcctagaaaatatttcaacttccccatcatagacatctcgaatttcggaatcatgatcctactaaactcttcacaagtagatttgttagtagacccaaatataatatcatcaacataaatttggcatacaaacaaaacttttgaaatggttttagtaaagagagtaggatcggctttactgactctgaagccattagtgataagaaaatctcttaggcattcataccatgctgttggggcttgcttgagcccataaagcgcctttgagagtttataaacatggttagggtactcactatcttcaaagccgagaggttgctcaacatagacctattcaccccatttgatcacttttttggtccttcaggatctaatagttatgtataatttagagtctcttgtttaatggccagatatttctaattaatctaagaatttatgatattttttaattttttatcatgtctgatgagaattaacataaaggctcaattgggtcctgaattaataatagagtgaaaattaatccagaggctctattagaaccttcaattagtaataccaagatatatataagatagtagagtatagtttaaatgttggcattgttcattctttcttttgttatttaatttatgctttccacggtggttagtggttacttctgaagggtccaaataatgcatgaagagtttgaggacaagaagtctgccctaaaaatagcgatgcaaaggcatggtgtccaagccatacatatagcgcactaattttatcagcagaacaatggtatttataggtcctagtgcccaggcaacaagagacacgaataaagcatcgatcacgacaccatggcggcgacaatggcagtgacgacgatggtgacgaggagcaaggagagctggtcgtcattgcaggtcccggcggtggcattcccttggaagccacgaggtggcaagaccggcggcctcgagttccctcgccgggcgatgttcgccagcgtcggcctcaacgtgtgcccgggcgtcccggcggggcgcgacccgcgggagcccgatcccaaggtcgtccgggcggcctgcggcctggtccaggcacaagtcctcttccaggggtttaactgggagtcgtgcaagcagcagggaggctggtacaacaggctcaaggcccaggtcgacgacatcgccaaggccggcgtcacgcacgtctggctgcctccaccctcgcactccgtctcgccacaaggctacatgccaggccgcctatacgacctggacgcgtccaagtacggcacggcggcggagctcaagtccctgatagcggcgttccacggcaggggcgtgcagtgcgtggcggacatcgtcatcaaccaccggtgcgcggaaaagaaggacgcgcgcggcgtgtactgcatcttcgagggcgggactcccgacgaccgcctggactggggccccgggatgatctgcagcgacgacacgcagtactcggacgggacggggcaccgcgacacgggcgaggggttcgcggcggcgcccgacatcgaccacctcaacccgcgcgtgcagcgggagctctccgcctggctcaactggctcaggtccgacgccgtggggttcgacggctggcgcctcgacttcgccaagggctactcgccggccgtcgccagaatgtacgtggagagcacggggccgccgagcttcgtcgtcgcggagatatggaactcgctgagctacagcggggacggcaagccggcgcccaaccaggaccagtgccggcaggagctgctggactggacgcgggccgtcggcgggcccgccatggcgttcgacttccccaccaagggcctgctgcaggcgggcgtgcagggggagctgtggcggctgcgcgacagctccggcaacgcggccggcctgatcgggtgggcgcccgagaaggccgtcaccttcgtcgacaaccatgacaccgggtcgacgcagaagctctggccgttcccatccgacaaggtcatgcagggctacgcctacatcctcacccatccaggagtcccctgcattttctacgaccacatgttcgactggaacctgaagcaggagatatccacgctgtctgccatcagggcgcggaacggcatccgcgccgggagcaagctgcggatcctcgtggcggacgcggacgcgtacgtggccgtcgtcgacgagaaggtcatggtgaagatcgggacaaggtacggcgtgagcagcgtggtcccgtcggatttccacccggcggcgcacggcaaggactactgcgtctgggagaaagcgagcctccgcgtcccggcggggcgccacctctagcagctcagattgctcagtcttgtgctgcattgcaaacacagcagcacgacactgcataacgtcttttccttgagatctgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagctactttagactgtgttcggcgttccccctaaatttctccccctatatctcactcacttgtcacatcagcgttctctttcccctatatctccacgtcgatgattccgatgacttcgtaggttcctagctcaagccgctcgtgtccaagcgtcacttacgattagctaatgattacggcatctaggaccgactagctaactaactagtacgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgggcccaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgtgggcgttaaccttctgttaacctaaaagctcttgcccaaacagcagaatcggcgctaattgccagcggcggaacttttccagtttcgcgaaaaatatcgccactggcaaggaatgggtttgagatggcgaagtctgtcctaaaagcagcgcctgtagttgtagggttgacggccttgatggagcgtcatgccgatgccctctcgagccaacttcaagcacatcatcttaaggttttcccgccgcattccgagaagggcattcgaacattcgggccatcggaggcgtccaagctgctcggcgttggcgagtcatatttacggcagaccgcgtctgagatgccagagttgaatgttagcatgagcccgggtggcaggcgaatgttctcaattgaagatatccatgcgattcggaagtatatggatcaggtcggccgcgggaaccggcgctacctgccacatcgtcgaggcggcgagcagcttcaggttatctctgtgatgaatttcaaaggtgggtcgggtaagaccaccaccgccgcgcatctggcgcagtacctcgctatgcgcggatatcgagtcttggccattgatctcgatcctcaagcgagcctttctgcactctttgggagccaaccggagacggacgttggcccgaacgaaacgctctacggcgctataaggtatgatgatgagcaggtggcaatcgaacgagtcgtccgagggacttacattcccgacctccacctgattcctggtaatcttgagctgatggagtttgaacacgatacgccacgcgcgctgatgaaccgcaaagagggcgacacgctcttttatggtcgcatcagccaagtaattgaagatatcgcggataactatgacgtcgtggtcatcgactgccctccccagcttgggtatctcacgctatccgcattgactgcggcgacgtccattcttgtcacggtccatccgcagatgctggatgtgatgtcgatgaaccagtttctggcaatgacatcgaaccttttgcgtgaaatcgagaatgctggcgccaagttcaagtttaattggatgcgctatctgataacccgtttcgaaccgagcgacggaccacagaaccaaatggtaggttatctgcggtcgatttttggcgaaaatgtcctcaattttccgatgcttaaaaccaccgcggtttcggacgctggcctgacaaaccagactctattcgaagtggagcgtggcctgttcacgcgctcgacctatgatcgagccttggaggcgatgaacgccgtcaacgacgagatcgaaacactgatcaaaaaagcatggggtaggcccacatgagccggaagcacatccttggcgtctcaactgacgcccctgagacgtcgcccgccgacaataggacggcaaagaaccgctccatgccgctcctcggcgtaacaaggaaggagcgcgatccggcaacgaagctcacagcgaacattggtaacgcactgcgagagcaaaacgatcgtcttagccgtgccgaagagatcgagcggcgtctcgctgaaggtcaggcagtgatagagttggatgcctcgtcaatagaaccgtctttcgtgcaggatcgtatgcgaggggacattgacgggctccttacttcgatccgggaacaaggacagcaagtcccaatccttgtgcgaccgcatccgagccagccgggccgatatcaggttgccttcggccaccgccggctacgcgccgtttcagaactcggacttccggtcagagcggtcgttcgcgaactgacggacgagcaagtggtcgtagcacagggtcaggaaaacaatgagcgcgaagatcttaccttcatcgaaaaggcgcgcttcgcacatcgcctgaacaggcagttttctcgagagattgtcatcgccgcgatgtcgatcgacaagagcaatttgtccaagatgcttctgctcgttgacgccctcccctctgaactgaccgatgctattggtgccgctcctggtgttggacggccgagttggcaacaacttgccgagctgattgagaaagtttcttcaccggccgacgtggctaaatatgctatgtcggaggaagttcaagcgctgccatcggcagaacgattcaaggcggtgatcgctagtctgaagcccagtcgggttgcgcgtggacttcccgaggtcatggccaccccagacggcaccagaattgcacaggtgacgcagagcaaggccaaactggaaatcacgattgacaggaaggcgacgcccgattttgcgaccttcgtgctcgatcatgtgccagcgctgtatcaagcgtaccacgctgagaaccaacggaaacggggagagtaaaccgcaaaagaaaagagccccctcaacgtcgccgtcgcggaagcccttctgtctctctagcgcgaacagaatcgcatttcctcgaatcctcgtcaagagtttttagcgccgttttggtgagctgatttcctttgcctgctgaaaggtgaaagatgatgcagacaggaagtgtaacgacgccattcgggcggcggccaatgacgcttgcgcttgtgcggcgccagacggcgctggccgatatcaaacaaggcaagacagcggacaagtggaaggtctttagagacgcgtccgcggctatggaactacttggaatccagtccaacagtcttgccgtccttgatgcgctattgagctttcacccggaaacggagttgcgtcaggaggcacagctgatcgtcttcccgtcgaatgctcagcttgcccttcgggcgcatgggatggctggcgcgactttgcgtaggcacatcgccatgctcgtggagtcaggcttgatcgtccggaaggatagcgccaacggaaagcgttacgctcgtaaggatggcgctggtcagatcgagcgcgcgtttggcttcgatttgtctccgcttctcgcgcggtcggaagagctagcgatgatggcacagcaggtgatggccgatcgagcagcattcaggatggccaaagaaagtctgacgatttgccgacgggacgttcggaagctaattacggcagctatggaagagggagcggagggcgactggcaagctgtcgaggaagtctatgtggaacttgtgggtagaattccacgcgccccgacgcttgctgatgtagagtcaattctcgaagagatgtggatgctccaggaagagataatcaaccggttggaaattagagacaattcagaaaataatagcaccaatgctgcccagagcgagcagcacatacagaattcaaaacccgaatccgttaatgaacttgaacctcgctctgaaaaggagcagggcgctaagccgagtgaaatagaccgggcaaggagcgagccgataaaagcgttccccctcgggatgatcctgaaagcatgcccgaccattggcaactatgggccgagcggtgcggttgctagctggcgtgacctcatgtcggctgcggtggtggttcggtctatgctgggggtcagcccgtcggcttaccaagacgcgtgtgaggcaatgggaccggagaatgcggcagcagcgatggcgtgcattttggagcgagcgaacttcatcaattcgcccgggggctatctccgagatctgacacggcggagcgagcttgggaagttttcacttggcccgatgataatggcgctcttgaaggctagcgggcaggggacgttgcggtttggctagaattagcgagtatggagcaggatggtctgtggtcagctgaccacagacctaataggttgaaaacatgagcgttttttggatgatcgacagaccatccgattcccggagtaccaagcgtgctctgatgggagcgataacattactcaacaagcacgaaggccccatgccgatcgttgatcgtgaaggagagcctgctctacatgcggcggtattttgccggccgaggcatgtagtcgcggagcactgcctatttactgccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaaccctgcaggccggccgtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaaccggccggcctgcaggtcgaggaggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctaaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtaccgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttag

SEQ ID NO: 52 - protein, 1368 aa, Streptococcus pyogenes [sequence omitted]

SEQ ID NO: 53 - DNA, 37427 bp, Artificial
  Vector 8
gtttacccgccaatatatcctgtcaaacactgatagttttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatcctgaggaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgaatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcaagcttggcgcgccggtcacccggtccgggcctagaaggccacccgggggctcggcgttaggcttttagtccgctaggtggctagaccgaggttaggacgctagttcactaggggcctagtggtgttttaaggatatccccccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaaggttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccaagcttggcgcgccggtcacccggtccgggcctagaaggccacccggggcgacttattgaactagtctagggcgcggctaacaacctagcttagattgccttgtctaaacccttaggctaacgcgccacgatatccccacccagcaggcagcagcagtatccaactagtcatgtatccagcctaaattgaaaagtcagatcatgtgtaacatggccctcaatatttcgatgttgccttgtggaaaaaatagctggtattggtactgtgttttttactccttccagctaccgacgttcagtgttagtgcacaaaatgttcatccatggtagtttgtctacattgcagtcatgtaaagttaaacattcacgatttctgtacttttgcatgtgtaactaaatgaaatggtgtgttacattcattccttcaatcaaataatccatagaaacaaactggtttgtaactattgtaactagtcgctagtgtccatggtattttcgattgtggaacataattagtttaatctgcttcagtataacttaagccggctttatcctgtgtatgcatcagcttcgctccattgaacatccaaacatcagtataagcattttgtggcgactaatcatccggatatcggaccgattaaactttaattcggtccgataacttcgtatagcatacattatacgaagttatatgcatacgcgtcttaagtcgatcgctatcaactttgtatagaaaagttgggccgaattcgagctcggtacggccagaatggcccggaccgggttaccgaattcgagctcggtaccctgggatccggtgcgggcctcttcgctattacgccagctggcgaaagggggatgtgctgcaaggcgattaagttgggtaacgccagggttttcccagtcacgacgttgtaaaacgacggccagtgccaagctcagatcagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgctgatccgatatcgatgggccctggccgaagcttggtcacccggtccgggcctagaaggccagcttcaagtttgtacaaaaaagcaggctccggccagaatggcccggaccgggttaccgaattcgagctcggtaccctgggatccgatatcgatgggccctggccgaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataatgaggatcgaggatggttttagagctagaaatagcaagttaaaataaggctagtccgttatcaacttgaaaaagtggcaccgagtcggtgctttttttttgcggccgcgaattcctgcagggccctcttgtcggaccagttgcccaccacgttggtgaggggcacccagctttcttgtacaaagtggccgttaacggatcggccagaatggcccggaccgggttaccgcataatgaggatcgaggatgaggcggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgagggtagtggatgatgagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccgcctcatcctcgatcctcattatgccctgcagggccctcttgtcggaccagttgcccaccacgttggtgaggggcaactttattatacaaagttgatcacgtgagagtctaaaaacggcccctaactaacgcttagttgcccgctagattagtcccccgttagtgcctagttagacacacgacgaactaggggctataaggatttaaatcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagggcgatccgatatcgatgggccctggccgaagcttggtcacccggtccgggcctagaaggccgcttgcatgcctgcaggtcgactctagaggatctgcaccggacactgtctggtggcataccagacagtccggtgtgccagatcagggcacccttcggttcctttgctcctttgcttttgaaccctaactttgatcgtttattggtttgtgttgaacctttatgcacctgtggaatatataatctagaacaaactagttagtccaatcatttgtgttgggcattcaaccaccaaaattatttataggaaaaggttaaaccttatttccctttcaatctccccctttttggtgattgatgccaacacaaaccaaagaaaatatataagtgcagaattgaactagtttgcataaggtaagtgcataggttacttagaattaaatcaatttatacttttacttgatatgcatggttgctttcttttattttaacattttggaccacatttgcaccacttgttttgttttttgcaaatctttttggaaattctttttcaaagtcttttgcaaatagtcaaaggtatatgaataagattgtaagaagcattttcaagatttgaaatttctccccctgtttcaaatgcttttcctttgactaaacaaaactccccctgaataaaattctcctcttagctttcaagagggttttaaatagatatcaattggaaatatatttagatgctaattttgaaaatataccaattgaaaatcaacataccaatttgaaattaaacataccaatttaaaaaatttcaaaaagtggtggtgcggtccttttgctttgggcttaatatttctccccctttggcattaatcgccaaaaacggagactttgtgagccatttatactttctccccattggtaaatgaaatatgagtgaaagattataccaaatttggacagtgatgcggagtgacggcgaaggataaacgataccgttagagtggagtggaagccttgtcttcgccgaagactccatttccctttcaatctacgacttagcatagaaatacacttgaaaacacattagtcgtagccacgaaagagatatgatcaaaggtatacaaatgagctatgtgtgtaatgtttcaatcaaagtttcgagaatcaagaatatttagctcattcctaagtttgctaaaggttttatcatctaatggtttggtaaagatatcgactaattgttctttggtgctaacataagcaatctcgatatcacccctttgttggtgatccctcaaaaagtgataccgaatgtctatgtgcttagtgcggctgtgttcaacgggattatccgccatgcagatagcactctcattgtcacataggagagggactttgctcaatttgtagccatagtccctaaggttttgcctcatccaaagtaattgcacacaacaatgtcctgcggcaatatacttggcttcggcggtagaaagagctattgagttttgtttctttgaagtccaagacaccagggatctccctagaaactgacaagtccctgatgtgctcttcctatcaattttacaccctgcccaatcggcatctgaatatcctattaaatcaaaggtggatcccttggggtaccaaagaccaaatttaggagtgtaaactaaatatctcatgattcttttcacggccctaaggtgaacttccttaggatcggcttggaatcttgcacacatgcatatagaaagcatactatctggtcgagatgcacataaatagagtaaagatcctatcatcgaccggtataccttttggtctacggatttacctcccgtgtcgaggtcgagatgcccattagttcccatgggtgtcctgatgggcttggcatccttcattccaaacttgttgagtatgtcttgaatgtactttgtttggctgatgaaggtgccatcttggagttgcttgacttgaaatcctagaaaatatttcaacttccccatcatagacatctcgaatttcggaatcatgatcctactaaactcttcacaagtagatttgttagtagacccaaatataatatcatcaacataaatttggcatacaaacaaaacttttgaaatggttttagtaaagagagtaggatcggctttactgactctgaagccattagtgataagaaaatctcttaggcattcataccatgctgttggggcttgcttgagcccataaagcgcctttgagagtttataaacatggttagggtactcactatcttcaaagccgagaggttgctcaacatagacctattcaccccatttgatcacttttttggtccttcaggatctaatagttatgtataatttagagtctcttgtttaatggccagatatttctaattaatctaagaatttatgatattttttaattttttatcatgtctgatgagaattaacataaaggctcaattgggtcctgaattaataatagagtgaaaattaatccagaggctctattagaaccttcaattagtaataccaagatatatataagatagtagagtatagtttaaatgttggcattgttcattctttcttttgttatttaatttatgctttccacggtggttagtggttacttctgaagggtccaaataatgcatgaagagtttgaggacaagaagtctgccctaaaaatagcgatgcaaaggcatggtgtccaagccatacatatagcgcactaattttatcagcagaacaatggtatttataggtcctagtgcccaggcaacaagagacacgaataaagcatcgatcacgacaccatggcggcgacaatggcagtgacgacgatggtgacgaggagcaaggagagctggtcgtcattgcaggtcccggcggtggcattcccttggaagccacgaggtggcaagaccggcggcctcgagttccctcgccgggcgatgttcgccagcgtcggcctcaacgtgtgcccgggcgtcccggcggggcgcgacccgcgggagcccgatcccaaggtcgtccgggcggcctgcggcctggtccaggcacaagtcctcttccaggggtttaactgggagtcgtgcaagcagcagggaggctggtacaacaggctcaaggcccaggtcgacgacatcgccaaggccggcgtcacgcacgtctggctgcctccaccctcgcactccgtctcgccacaaggctacatgccaggccgcctatacgacctggacgcgtccaagtacggcacggcggcggagctcaagtccctgatagcggcgttccacggcaggggcgtgcagtgcgtggcggacatcgtcatcaaccaccggtgcgcggaaaagaaggacgcgcgcggcgtgtactgcatcttcgagggcgggactcccgacgaccgcctggactggggccccgggatgatctgcagcgacgacacgcagtactcggacgggacggggcaccgcgacacgggcgaggggttcgcggcggcgcccgacatcgaccacctcaacccgcgcgtgcagcgggagctctccgcctggctcaactggctcaggtccgacgccgtggggttcgacggctggcgcctcgacttcgccaagggctactcgccggccgtcgccagaatgtacgtggagagcacggggccgccgagcttcgtcgtcgcggagatatggaactcgctgagctacagcggggacggcaagccggcgcccaaccaggaccagtgccggcaggagctgctggactggacgcgggccgtcggcgggcccgccatggcgttcgacttccccaccaagggcctgctgcaggcgggcgtgcagggggagctgtggcggctgcgcgacagctccggcaacgcggccggcctgatcgggtgggcgcccgagaaggccgtcaccttcgtcgacaaccatgacaccgggtcgacgcagaagctctggccgttcccatccgacaaggtcatgcagggctacgcctacatcctcacccatccaggagtcccctgcattttctacgaccacatgttcgactggaacctgaagcaggagatatccacgctgtctgccatcagggcgcggaacggcatccgcgccgggagcaagctgcggatcctcgtggcggacgcggacgcgtacgtggccgtcgtcgacgagaaggtcatggtgaagatcgggacaaggtacggcgtgagcagcgtggtcccgtcggatttccacccggcggcgcacggcaaggactactgcgtctgggagaaagcgagcctccgcgtcccggcggggcgccacctctagcagctcagattgctcagtcttgtgctgcattgcaaacacagcagcacgacactgcataacgtcttttccttgagatctgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagctactttagactgtgttcggcgttccccctaaatttctccccctatatctcactcacttgtcacatcagcgttctctttcccctatatctccacgtcgatgattccgatgacttcgtaggttcctagctcaagccgctcgtgtccaagcgtcacttacgattagctaatgattacggcatctaggaccgactagctaactaactagtacgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgggcccaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgtgggcgttaaccttctgttaacctaaaagctcttgcccaaacagcagaatcggcgctaattgccagcggcggaacttttccagtttcgcgaaaaatatcgccactggcaaggaatgggtttgagatggcgaagtctgtcctaaaagcagcgcctgtagttgtagggttgacggccttgatggagcgtcatgccgatgccctctcgagccaacttcaagcacatcatcttaaggttttcccgccgcattccgagaagggcattcgaacattcgggccatcggaggcgtccaagctgctcggcgttggcgagtcatatttacggcagaccgcgtctgagatgccagagttgaatgttagcatgagcccgggtggcaggcgaatgttctcaattgaagatatccatgcgattcggaagtatatggatcaggtcggccgcgggaaccggcgctacctgccacatcgtcgaggcggcgagcagcttcaggttatctctgtgatgaatttcaaaggtgggtcgggtaagaccaccaccgccgcgcatctggcgcagtacctcgctatgcgcggatatcgagtcttggccattgatctcgatcctcaagcgagcctttctgcactctttgggagccaaccggagacggacgttggcccgaacgaaacgctctacggcgctataaggtatgatgatgagcaggtggcaatcgaacgagtcgtccgagggacttacattcccgacctccacctgattcctggtaatcttgagctgatggagtttgaacacgatacgccacgcgcgctgatgaaccgcaaagagggcgacacgctcttttatggtcgcatcagccaagtaattgaagatatcgcggataactatgacgtcgtggtcatcgactgccctccccagcttgggtatctcacgctatccgcattgactgcggcgacgtccattcttgtcacggtccatccgcagatgctggatgtgatgtcgatgaaccagtttctggcaatgacatcgaaccttttgcgtgaaatcgagaatgctggcgccaagttcaagtttaattggatgcgctatctgataacccgtttcgaaccgagcgacggaccacagaaccaaatggtaggttatctgcggtcgatttttggcgaaaatgtcctcaattttccgatgcttaaaaccaccgcggtttcggacgctggcctgacaaaccagactctattcgaagtggagcgtggcctgttcacgcgctcgacctatgatcgagccttggaggcgatgaacgccgtcaacgacgagatcgaaacactgatcaaaaaagcatggggtaggcccacatgagccggaagcacatccttggcgtctcaactgacgcccctgagacgtcgcccgccgacaataggacggcaaagaaccgctccatgccgctcctcggcgtaacaaggaaggagcgcgatccggcaacgaagctcacagcgaacattggtaacgcactgcgagagcaaaacgatcgtcttagccgtgccgaagagatcgagcggcgtctcgctgaaggtcaggcagtgatagagttggatgcctcgtcaatagaaccgtctttcgtgcaggatcgtatgcgaggggacattgacgggctccttacttcgatccgggaacaaggacagcaagtcccaatccttgtgcgaccgcatccgagccagccgggccgatatcaggttgccttcggccaccgccggctacgcgccgtttcagaactcggacttccggtcagagcggtcgttcgcgaactgacggacgagcaagtggtcgtagcacagggtcaggaaaacaatgagcgcgaagatcttaccttcatcgaaaaggcgcgcttcgcacatcgcctgaacaggcagttttctcgagagattgtcatcgccgcgatgtcgatcgacaagagcaatttgtccaagatgcttctgctcgttgacgccctcccctctgaactgaccgatgctattggtgccgctcctggtgttggacggccgagttggcaacaacttgccgagctgattgagaaagtttcttcaccggccgacgtggctaaatatgctatgtcggaggaagttcaagcgctgccatcggcagaacgattcaaggcggtgatcgctagtctgaagcccagtcgggttgcgcgtggacttcccgaggtcatggccaccccagacggcaccagaattgcacaggtgacgcagagcaaggccaaactggaaatcacgattgacaggaaggcgacgcccgattttgcgaccttcgtgctcgatcatgtgccagcgctgtatcaagcgtaccacgctgagaaccaacggaaacggggagagtaaaccgcaaaagaaaagagccccctcaacgtcgccgtcgcggaagcccttctgtctctctagcgcgaacagaatcgcatttcctcgaatcctcgtcaagagtttttagcgccgttttggtgagctgatttcctttgcctgctgaaaggtgaaagatgatgcagacaggaagtgtaacgacgccattcgggcggcggccaatgacgcttgcgcttgtgcggcgccagacggcgctggccgatatcaaacaaggcaagacagcggacaagtggaaggtctttagagacgcgtccgcggctatggaactacttggaatccagtccaacagtcttgccgtccttgatgcgctattgagctttcacccggaaacggagttgcgtcaggaggcacagctgatcgtcttcccgtcgaatgctcagcttgcccttcgggcgcatgggatggctggcgcgactttgcgtaggcacatcgccatgctcgtggagtcaggcttgatcgtccggaaggatagcgccaacggaaagcgttacgctcgtaaggatggcgctggtcagatcgagcgcgcgtttggcttcgatttgtctccgcttctcgcgcggtcggaagagctagcgatgatggcacagcaggtgatggccgatcgagcagcattcaggatggccaaagaaagtctgacgatttgccgacgggacgttcggaagctaattacggcagctatggaagagggagcggagggcgactggcaagctgtcgaggaagtctatgtggaacttgtgggtagaattccacgcgccccgacgcttgctgatgtagagtcaattctcgaagagatgtggatgctccaggaagagataatcaaccggttggaaattagagacaattcagaaaataatagcaccaatgctgcccagagcgagcagcacatacagaattcaaaacccgaatccgttaatgaacttgaacctcgctctgaaaaggagcagggcgctaagccgagtgaaatagaccgggcaaggagcgagccgataaaagcgttccccctcgggatgatcctgaaagcatgcccgaccattggcaactatgggccgagcggtgcggttgctagctggcgtgacctcatgtcggctgcggtggtggttcggtctatgctgggggtcagcccgtcggcttaccaagacgcgtgtgaggcaatgggaccggagaatgcggcagcagcgatggcgtgcattttggagcgagcgaacttcatcaattcgcccgggggctatctccgagatctgacacggcggagcgagcttgggaagttttcacttggcccgatgataatggcgctcttgaaggctagcgggcaggggacgttgcggtttggctagaattagcgagtatggagcaggatggtctgtggtcagctgaccacagacctaataggttgaaaacatgagcgttttttggatgatcgacagaccatccgattcccggagtaccaagcgtgctctgatgggagcgataacattactcaacaagcacgaaggccccatgccgatcgttgatcgtgaaggagagcctgctctacatgcggcggtattttgccggccgaggcatgtagtcgcggagcactgcctatttactgccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaaccctgcaggccggccgtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaaccggccggcctgcaggtcgaggaggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctaaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtaccgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttag

SEQ ID NO: 54 - DNA, 26760 bp, Artificial
  Vector 9
ctcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaacgaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacctagctaggttacctcgagggtgctaagcacgacatccatggcgaccccagtgatggcaactaagtggatcaacagcaacttttgctccgatttgcgatataatttgtcaaaacatgcctctaaaatcactctaacatcaaatttcttgaataacaattttatacactcccctcctccaacttgttatgtgcccttctgacccttcttgttttgtttgctagttaaccatgtaggaaaaagtatcactccactcaatagtattttcacttcatctggccataaataattttggcctaattcagcatcacgtatcaggagtcaataagcttgtctgtccgtctgtatttatcatctctcttcgtgctactatcacctccccttttcttatggatttttcctgttaaaaaacaaaaaggaacaggtaacccacttgaattaggacaccaatgtaggtgccaccacccgtttccttctgttgagtgtgcacgcttattggttcaacctcagaattaaattcttcataatcccctgttgagagaaaattataatagacaaatcaaattgtgtggacttgccatttcccaaaacattttcattttgtgcgcgtgtgggtggtggggtgcgttttattagaatgaagactgtaaaaaagaggagtgtaggatgataagaagtagtaaatgtcagttgtcaaaagatgaaaagcaacggaggaagggaccaaaccttgacctatggaaaactgagtgctatggtaattattgtcacaggatttaggatgattaataatagttcggaccacaaataaacagctttaagaagttcaactttcccccacggatagcaaatttggttggaccatctttgatgaaagtccccaatctcataattgccaaccttttttatacgaaactagtattttcataattatcaagaatcttcaactcatcagtgatcgctcatttctgattaagaaaaaaaaagggtgagtaaatgaatccattttgtctgttctccatggatctcgacgcggccgctctagaaagcttagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagccatggctgcaactactcttacatctgctttacctggtgctttcagttcatcccagagaccaagtgctcctttcaacttacaaagatcacctagagtgcttagaaggttcaacagaaagacaggacgtcaacctcgtggacttgttcgtgctgcaaaggctcaagcggcgcaaaacctgccagagaaattcgatgaaacaagactctgggaggccctcaggggatttggggttagtccaagtagggttacttacgctcccgtcggattcggagattaccactggaccgtcacagatgaagacgggagaccttggttcgcaactgtcagtgacctcgaacacaaagagcattgcgggcagggagcacaagcagcccttaaaggactcagacaagctatggacactgccctcgcacttagagatagggacggactcagattcgtggttgctccagtggcagcaacagatgggggtggccctgtccttccccttgacgctaggtatgcactcacagtcttccctcacgtcccaggaagaacaggagagttcggacaaagactcacagaggcagagagggacagactgcttgctcttctggcagaactccacggaagaacacctcctgaaacaaccccaccagccgatatggaaccaccaggacttcctggtgttagagcagcactcgccgaaagtgaaggaccttggagtggaggaccatttgcagaacccgctagacttcttctcagagaacacgaggccacactgcacgcaagactcgctgaattcgaagccctcgtcgcaagagttaagggtcgtggagcacctcttgtcgttacccacggagaaccacacccaggcaacttgatcctcggagaggaaggctatctcctcgtggactgggatacagttggactggctccagctgaaagggatttgagtctcatctcagacgacccagctgacctcgcaagatacgcagagcttacaggaagaactccagacccagacgcactcgcactctatagactgcgttggagtctccttgatgtggctgagttcgtcgagtggttcagggctgaacaccaaagaacccaagacaccgagagtgcatggaaggggttcactgacacacttgggcaattggctgctggtggatcagctgcatagcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagaggtaccatcatgtcgtgcttagcacgtgatgcatcatagatgcggtaaattattactttctgtgactgggacaatgtgctcctccagtggccacgtatcggtaaaccttgtgccagaacactaatatttatataatcaacaataaagaatggtaagcattagacaaagacaaaaacaatttttaataatttacctgtactaattagaaggggtttgatttaattttattaaacttaacatgtgcaatatgtccctttgtttagaggaaaacaattacggtatttccttactaacgtaaactctgaatataatcatacatctgtattctgaaaaagaaaaaagaactagagataaaagcgtagaaacaacagtatgtggtcatagtcatacacgtaaagggatgaaaattgaaaatagaacctgcaggaaataagtttgcatttaatttggatatatatcttgaagtgtaaggttaacctctcagctattaaatagtactactactaacactcaaatagtacttctactagcactcacggtaacaatctcttagtagggatgggaataggccagatcggcctacaggggtctacgacttgaggtgctaagcacgacatccatggcttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattggtgctaagcacgacatccagttttagagctagaaatagcaagttaaaataaggctagtccgttatcaacttgaaaaagtggcaccgagtcggtgcttttttttcggaccgggttaccagtctaaaaacggcccctaactaacgcttagttgcccgctagattagtcccccgttagtgcctagttagacacacgacgaactaggggctactagtagcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcacctaaaaagaagaggaaagttatggacaaaaagtactccatagggctcgatatcggcacaaacagtgtggggtgggcagtcatcactgacgactacaaggtcccctccaagaagttcaaggtcctcggcaatacagaccgccactccatcaagaagaacctcatcggagcactgttgttcgactccggagaaactgccgaagcaaccagactcaagaggaccgccagaagaaggtacacaaggcgcaagaacaggatctgctacctccaggagatcttcagtaacgagatggcaaaggtcgacgactctttcttccacaggctcgaggaatccttcctcgtcgaggaggacaagaagcatgagagacaccccatcttcggaaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtcgcctaccacgagaagtacccaaccatctaccacctgaggaagaagctcgtcgacagtaccgacaaggctgacctcaggctcatctacctcgcactcgcccacatgattaagttcaggggccacttcctcatagagggagacctcaacccagacaactccgacgtcgacaaactcttcatccaactcgtgcagacctacaatcaactctttgaagagaacccaatcaacgcctccggagtggatgctaaggctatattgtccgccaggctctccaaatcaagacgcctcgaaaacctcatcgcccagctcccaggggagaagaaaaatagcctcttcgggaacctcatagccctgtcccttggactcacccctaacttcaaatcaaatttcgacctcgcagaggacgctaagcttcaactctccaaggacacctacgacgacgacctcgataacctcctcgcccaaatcggtgatcaatacgctgacctcttcctcgctgctaagaacctctccgacgccatactcctctccgacattctgagggtcaacaccgagatcacaaaggctcccttgtccgcctccatgattaaacgctacgacgaacaccaccaggacctcaccctcttgaaggcactggttagacagcagctccccgagaagtacaaggaaatcttcttcgaccaatcaaaaaacggctacgccggatacatcgacggaggagcatcccaggaagagttctacaagttcatcaaaccaattctcgaaaagatggacggaacagaggagctcttggtcaagctcaacagggaggacctcctcagaaagcagagaaccttcgacaacggcagtatcccccaccagatccaccttggagagttgcacgcaatcctcaggaggcaagaggacttctaccccttcctcaaggacaacagggagaagatcgagaagatccttacattccgcatcccctactacgtcggacctttggcaagaggaaactcccgcttcgcatggatgactcgcaagagtgaggaaaccatcaccccttggaacttcgaggaggtcgtcgataagggagcttcagcccagtccttcatcgagcgcatgaccaacttcgataaaaatctccccaatgaaaaagtcctccccaagcacagtctgctctacgagtacttcacagtctacaacgagctcaccaaggtcaagtacgtcaccgaaggcatgagaaaacccgccttcctcagtggcgagcagaagaaggcaatcgtggacttgctgttcaagaccaaccgcaaggtcacagtcaagcaattaaaagaggactacttcaagaaaatagagtgcttcgacagtgtcgagatctctggggtcgaggacaggttcaacgcatccttggggacctatcacgacctcctcaagatcattaaagacaaggacttcctcgacaacgaggagaacgaggacatactggaggacatcgtcctcaccctcactctctttgaggacagggagatgatagaggagcgcctcaaaacctacgcccacctcttcgacgacaaggtgatgaaacagctcaagaggcgcagatacaccggatggggtagactctccaggaagctgattaatggcatccgcgacaaacagtccggcaagaccatcctcgacttcctcaagagtgacggattcgccaaccgcaacttcatgcagctcatacacgacgactccctcaccttcaaggaggacatccaaaaagcccaagtctccggacagggagactcattgcacgaacacatcgccaacttggctggatctcctgctattaaaaagggcatcctccaaaccgtcaaggtggtcgacgaactcgtcaaggtcatgggtagacacaagcccgaaaatatcgtcatcgagatggcaagggagaaccagacaacccagaagggccaaaaaaactccagggagcgcatgaaacgcatcgaggagggaataaaggagctcgggtcccagatcctcaaggagcaccccgtcgaaaatactcaactccagaatgaaaagctctacctctactacctccaaaacggcagggatatgtacgtcgaccaagagctcgacattaatcgcctctccgactacgacgtcgatcacatcgtcccccagagtttcctcaaggacgactccatcgacaacaaggtcctcaccagatccgataaaaatcgcggaaagtccgacaacgtcccctctgaggaagtggttaagaagatgaaaaactactggagacagctcctcaacgcaaagctgatcacccagcgcaagttcgacaacctcacaaaggctgagagagggggactctctgagttggacaaggccggcttcatcaagagacaactcgtggaaacccgccagatcaccaagcatgtcgcacagattctcgactcccgcatgaatactaaatacgatgaaaatgacaagctcatcagggaggtcaaggtcatcaccctgaagtccaagctcgtctccgacttccgcaaggacttccagttctacaaggtccgcgagatcaacaactaccaccacgcccacgacgcatacctcaacgctgtggttggaacagcactcatcaagaagtaccccaagctcgagtccgagttcgtctacggcgactacaaggtctacgacgtcaggaagatgatcgccaagtccgagcaagagatcggaaaggccaccgcaaaatatttcttctactccaacataatgaacttcttcaaaaccgagatcaccctggctaacggagaaataaggaagaggcccctgatagaaaccaacggcgagacaggcgagattgtctgggacaaaggcagggacttcgcaaccgtcagaaaggtgctcagtatgcctcaggtcaacatagtcaaaaagaccgaagtccagactggaggattctccaaggagtccatcctccccaaaaggaactccgacaaactgatcgccaggaaaaaggactgggaccccaaaaaatatggcggcttcgactcccctactgttgcttacagtgtgctcgtcgtcgcaaaagtcgagaaggggaaatccaagaagctcaagtcagtgaaggagctcctcggcatcaccatcatggagaggtcctccttcgagaagaaccccatcgacttcctcgaggccaagggatataaggaggtcaagaaggacctcatcattaaactccccaagtactccctcttcgagctcgaaaacggacgcaagaggatgctcgcttcagctggtgaactccagaagggcaacgaactcgctttgccctctaaatacgtcaacttcctctacctcgcctcccactatgaaaagctcaagggctccccagaggacaacgagcagaagcaactcttcgtcgagcagcacaagcattacctcgacgagatcatcgagcagatctccgagttctccaagagagtcatcctcgctgacgcaaacctcgacaaggtcctcagtgcatataacaagcaccgcgacaaaccaataagggagcaggccgaaaatattatacacctgttcaccctcaccaacttgggagcaccagccgccttcaagtatttcgacaccaccatcgacagaaagcgctacacctccacaaaggaggtcctggacgccacacttatccaccagtccatcaccggcctctatgaaacacgcatcgacctctctcaattgggaggggacaagagaccaagagacagacacgatggagagcttggaggtagaaagagagcaaggtagttcgaactggccaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttggcgcgccgttaacttaacggcaaacgctaattagtcactaggcccaggaaacactaactaagccctagcttatcctagcgcaacctagttaggtcttggtaacccgaaatctagtctaggtgtgttttgcgatccgatatcgatgcggccgcggtaccggcggccgcgggcaactttattatacaaagttgatacccgggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattctagtggccggcccagctgatatctagacccagctttcttgtacaaagtggcccggggcggccgaagctggccttctaggcccggaccgggtgaccaagcttggcgcgcccagggcccatcgatatcggtacctacgcgttcgaatatccatggatccgaattccgcggccgcttggtaacccggtccgggccattctggccgatccgttaacgcccgggcaactttattatacaaagttgatggtacggatccgtcgacggcgcgccgcggacctgaattccagcacactggcggccgttactagtaacggccgccagtgtgctggaattcgcccttcccaagctttgctctagatcaaactcacatccaaacataacatggatatcttccttaccaatcatactaattattttgggttaaatattaatcattatttttaagatattaattaataagtgactagggtcacgtgaccctagtcacttatgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccaaacgtgcaagcgctactagacaattcagtacattaaaaacgtccgcaatgtgttattaagttgtctaagcgtcaatttatttacaattgaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggcgcgcgcggtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaacgcgcgcgggcgcgccttttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatggcgcgccggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtaggaacagtgaattggagttcgtcttgttataattagcttcttgggggatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatacttcgctcgtgaaaagcagcgctcagggggctagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtacgttggaatcgcttctacaaaa

SEQ ID NO: 55 - DNA, 26386 bp, Artificial
  Vector 10
ctcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaacgaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacctagctaggttacctcgagggtgctaagcacgacatccatggcgaccccagtgatggcaactaagtggatcaacagcaacttttgctccgatttgcgatataatttgtcaaaacatgcctctaaaatcactctaacatcaaatttcttgaataacaattttatacactcccctcctccaacttgttatgtgcccttctgacccttcttgttttgtttgctagttaaccatgtaggaaaaagtatcactccactcaatagtattttcacttcatctggccataaataattttggcctaattcagcatcacgtatcaggagtcaataagcttgtctgtccgtctgtatttatcatctctcttcgtgctactatcacctccccttttcttatggatttttcctgttaaaaaacaaaaaggaacaggtaacccacttgaattaggacaccaatgtaggtgccaccacccgtttccttctgttgagtgtgcacgcttattggttcaacctcagaattaaattcttcataatcccctgttgagagaaaattataatagacaaatcaaattgtgtggacttgccatttcccaaaacattttcattttgtgcgcgtgtgggtggtggggtgcgttttattagaatgaagactgtaaaaaagaggagtgtaggatgataagaagtagtaaatgtcagttgtcaaaagatgaaaagcaacggaggaagggaccaaaccttgacctatggaaaactgagtgctatggtaattattgtcacaggatttaggatgattaataatagttcggaccacaaataaacagctttaagaagttcaactttcccccacggatagcaaatttggttggaccatctttgatgaaagtccccaatctcataattgccaaccttttttatacgaaactagtattttcataattatcaagaatcttcaactcatcagtgatcgctcatttctgattaagaaaaaaaaagggtgagtaaatgaatccattttgtctgttctccatggatctcgacccgggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattctagtggccggcccagctgatatcatgtcgtgcttagcacgtgatgcatcatagatgcggtaaattattactttctgtgactgggacaatgtgctcctccagtggccacgtatcggtaaaccttgtgccagaacactaatatttatataatcaacaataaagaatggtaagcattagacaaagacaaaaacaatttttaataatttacctgtactaattagaaggggtttgatttaattttattaaacttaacatgtgcaatatgtccctttgtttagaggaaaacaattacggtatttccttactaacgtaaactctgaatataatcatacatctgtattctgaaaaagaaaaaagaactagagataaaagcgtagaaacaacagtatgtggtcatagtcatacacgtaaagggatgaaaattgaaaatagaacctgcaggaaataagtttgcatttaatttggatatatatcttgaagtgtaaggttaacctctcagctattaaatagtactactactaacactcaaatagtacttctactagcactcacggtaacaatctcttagtagggatgggaataggccagatcggcctacaggggtctacgacttgaggtgctaagcacgacatccatggcttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattggtgctaagcacgacatccagttttagagctagaaatagcaagttaaaataaggctagtccgttatcaacttgaaaaagtggcaccgagtcggtgcttttttttcggaccgggttaccagtctaaaaacggcccctaactaacgcttagttgcccgctagattagtcccccgttagtgcctagttagacacacgacgaactaggggctactagtagcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcacctaaaaagaagaggaaagttatggacaaaaagtactccatagggctcgatatcggcacaaacagtgtggggtgggcagtcatcactgacgactacaaggtcccctccaagaagttcaaggtcctcggcaatacagaccgccactccatcaagaagaacctcatcggagcactgttgttcgactccggagaaactgccgaagcaaccagactcaagaggaccgccagaagaaggtacacaaggcgcaagaacaggatctgctacctccaggagatcttcagtaacgagatggcaaaggtcgacgactctttcttccacaggctcgaggaatccttcctcgtcgaggaggacaagaagcatgagagacaccccatcttcggaaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtcgcctaccacgagaagtacccaaccatctaccacctgaggaagaagctcgtcgacagtaccgacaaggctgacctcaggctcatctacctcgcactcgcccacatgattaagttcaggggccacttcctcatagagggagacctcaacccagacaactccgacgtcgacaaactcttcatccaactcgtgcagacctacaatcaactctttgaagagaacccaatcaacgcctccggagtggatgctaaggctatattgtccgccaggctctccaaatcaagacgcctcgaaaacctcatcgcccagctcccaggggagaagaaaaatagcctcttcgggaacctcatagccctgtcccttggactcacccctaacttcaaatcaaatttcgacctcgcagaggacgctaagcttcaactctccaaggacacctacgacgacgacctcgataacctcctcgcccaaatcggtgatcaatacgctgacctcttcctcgctgctaagaacctctccgacgccatactcctctccgacattctgagggtcaacaccgagatcacaaaggctcccttgtccgcctccatgattaaacgctacgacgaacaccaccaggacctcaccctcttgaaggcactggttagacagcagctccccgagaagtacaaggaaatcttcttcgaccaatcaaaaaacggctacgccggatacatcgacggaggagcatcccaggaagagttctacaagttcatcaaaccaattctcgaaaagatggacggaacagaggagctcttggtcaagctcaacagggaggacctcctcagaaagcagagaaccttcgacaacggcagtatcccccaccagatccaccttggagagttgcacgcaatcctcaggaggcaagaggacttctaccccttcctcaaggacaacagggagaagatcgagaagatccttacattccgcatcccctactacgtcggacctttggcaagaggaaactcccgcttcgcatggatgactcgcaagagtgaggaaaccatcaccccttggaacttcgaggaggtcgtcgataagggagcttcagcccagtccttcatcgagcgcatgaccaacttcgataaaaatctccccaatgaaaaagtcctccccaagcacagtctgctctacgagtacttcacagtctacaacgagctcaccaaggtcaagtacgtcaccgaaggcatgagaaaacccgccttcctcagtggcgagcagaagaaggcaatcgtggacttgctgttcaagaccaaccgcaaggtcacagtcaagcaattaaaagaggactacttcaagaaaatagagtgcttcgacagtgtcgagatctctggggtcgaggacaggttcaacgcatccttggggacctatcacgacctcctcaagatcattaaagacaaggacttcctcgacaacgaggagaacgaggacatactggaggacatcgtcctcaccctcactctctttgaggacagggagatgatagaggagcgcctcaaaacctacgcccacctcttcgacgacaaggtgatgaaacagctcaagaggcgcagatacaccggatggggtagactctccaggaagctgattaatggcatccgcgacaaacagtccggcaagaccatcctcgacttcctcaagagtgacggattcgccaaccgcaacttcatgcagctcatacacgacgactccctcaccttcaaggaggacatccaaaaagcccaagtctccggacagggagactcattgcacgaacacatcgccaacttggctggatctcctgctattaaaaagggcatcctccaaaccgtcaaggtggtcgacgaactcgtcaaggtcatgggtagacacaagcccgaaaatatcgtcatcgagatggcaagggagaaccagacaacccagaagggccaaaaaaactccagggagcgcatgaaacgcatcgaggagggaataaaggagctcgggtcccagatcctcaaggagcaccccgtcgaaaatactcaactccagaatgaaaagctctacctctactacctccaaaacggcagggatatgtacgtcgaccaagagctcgacattaatcgcctctccgactacgacgtcgatcacatcgtcccccagagtttcctcaaggacgactccatcgacaacaaggtcctcaccagatccgataaaaatcgcggaaagtccgacaacgtcccctctgaggaagtggttaagaagatgaaaaactactggagacagctcctcaacgcaaagctgatcacccagcgcaagttcgacaacctcacaaaggctgagagagggggactctctgagttggacaaggccggcttcatcaagagacaactcgtggaaacccgccagatcaccaagcatgtcgcacagattctcgactcccgcatgaatactaaatacgatgaaaatgacaagctcatcagggaggtcaaggtcatcaccctgaagtccaagctcgtctccgacttccgcaaggacttccagttctacaaggtccgcgagatcaacaactaccaccacgcccacgacgcatacctcaacgctgtggttggaacagcactcatcaagaagtaccccaagctcgagtccgagttcgtctacggcgactacaaggtctacgacgtcaggaagatgatcgccaagtccgagcaagagatcggaaaggccaccgcaaaatatttcttctactccaacataatgaacttcttcaaaaccgagatcaccctggctaacggagaaataaggaagaggcccctgatagaaaccaacggcgagacaggcgagattgtctgggacaaaggcagggacttcgcaaccgtcagaaaggtgctcagtatgcctcaggtcaacatagtcaaaaagaccgaagtccagactggaggattctccaaggagtccatcctccccaaaaggaactccgacaaactgatcgccaggaaaaaggactgggaccccaaaaaatatggcggcttcgactcccctactgttgcttacagtgtgctcgtcgtcgcaaaagtcgagaaggggaaatccaagaagctcaagtcagtgaaggagctcctcggcatcaccatcatggagaggtcctccttcgagaagaaccccatcgacttcctcgaggccaagggatataaggaggtcaagaaggacctcatcattaaactccccaagtactccctcttcgagctcgaaaacggacgcaagaggatgctcgcttcagctggtgaactccagaagggcaacgaactcgctttgccctctaaatacgtcaacttcctctacctcgcctcccactatgaaaagctcaagggctccccagaggacaacgagcagaagcaactcttcgtcgagcagcacaagcattacctcgacgagatcatcgagcagatctccgagttctccaagagagtcatcctcgctgacgcaaacctcgacaaggtcctcagtgcatataacaagcaccgcgacaaaccaataagggagcaggccgaaaatattatacacctgttcaccctcaccaacttgggagcaccagccgccttcaagtatttcgacaccaccatcgacagaaagcgctacacctccacaaaggaggtcctggacgccacacttatccaccagtccatcaccggcctctatgaaacacgcatcgacctctctcaattgggaggggacaagagaccaagagacagacacgatggagagcttggaggtagaaagagagcaaggtagttcgaactggccaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttggcgcgccgttaacttaacggcaaacgctaattagtcactaggcccaggaaacactaactaagccctagcttatcctagcgcaacctagttaggtcttggtaacccgaaatctagtctaggtgtgttttgcgatccgatatcgatgcggccgcatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagccatggctgcaactactcttacatctgctttacctggtgctttcagttcatcccagagaccaagtgctcctttcaacttacaaagatcacctagagtgcttagaaggttcaacagaaagacaggacgtcaacctcgtggacttgttcgtgctgcaaaggctcaagcggcgcaaaacctgccagagaaattcgatgaaacaagactctgggaggccctcaggggatttggggttagtccaagtagggttacttacgctcccgtcggattcggagattaccactggaccgtcacagatgaagacgggagaccttggttcgcaactgtcagtgacctcgaacacaaagagcattgcgggcagggagcacaagcagcccttaaaggactcagacaagctatggacactgccctcgcacttagagatagggacggactcagattcgtggttgctccagtggcagcaacagatgggggtggccctgtccttccccttgacgctaggtatgcactcacagtcttccctcacgtcccaggaagaacaggagagttcggacaaagactcacagaggcagagagggacagactgcttgctcttctggcagaactccacggaagaacacctcctgaaacaaccccaccagccgatatggaaccaccaggacttcctggtgttagagcagcactcgccgaaagtgaaggaccttggagtggaggaccatttgcagaacccgctagacttcttctcagagaacacgaggccacactgcacgcaagactcgctgaattcgaagccctcgtcgcaagagttaagggtcgtggagcacctcttgtcgttacccacggagaaccacacccaggcaacttgatcctcggagaggaaggctatctcctcgtggactgggatacagttggactggctccagctgaaagggatttgagtctcatctcagacgacccagctgacctcgcaagatacgcagagcttacaggaagaactccagacccagacgcactcgcactctatagactgcgttggagtctccttgatgtggctgagttcgtcgagtggttcagggctgaacaccaaagaacccaagacaccgagagtgcatggaaggggttcactgacacacttgggcaattggctgctggtggatcagctgcatagcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagaggtaccggcggccgcgggcaactttattatacaaagttgatagatatcggtccgacggccagaatggccatctggattcagcaggcctagaaggccatttagtcctagcgatcgcgctgacaagcggtatttaaatcatcattctaggcgcgccacttacgcttgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccaaacgtgcaagcgctactagacaattcagtacattaaaaacgtccgcaatgtgttattaagttgtctaagcgtcaatttatttacaattgaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggcgcgcgcggtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttattttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaacgcgcgcgggcgcgccttttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatggcgcgccggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggggaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtaggaacagtgaattggagttcgtcttgttataattagcttcttgggggatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatacttcgctcgtgaaaagcagcgctcagggggctagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtacgttggaatcgcttctacaaaa

SEQ ID NO: 56 - DNA, 26340 bp, Artificial
  Vector 11
ctcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaacgaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacctagctaggttacctcgagcgaccccagtgatggcaactaagtggatcaacagcaacttttgctccgatttgcgatataatttgtcaaaacatgcctctaaaatcactctaacatcaaatttcttgaataacaattttatacactcccctcctccaacttgttatgtgcccttctgacccttcttgttttgtttgctagttaaccatgtaggaaaaagtatcactccactcaatagtattttcacttcatctggccataaataattttggcctaattcagcatcacgtatcaggagtcaataagcttgtctgtccgtctgtatttatcatctctcttcgtgctactatcacctccccttttcttatggatttttcctgttaaaaaacaaaaaggaacaggtaacccacttgaattaggacaccaatgtaggtgccaccacccgtttccttctgttgagtgtgcacgcttattggttcaacctcagaattaaattcttcataatcccctgttgagagaaaattataatagacaaatcaaattgtgtggacttgccatttcccaaaacattttcattttgtgcgcgtgtgggtggtggggtgcgttttattagaatgaagactgtaaaaaagaggagtgtaggatgataagaagtagtaaatgtcagttgtcaaaagatgaaaagcaacggaggaagggaccaaaccttgacctatggaaaactgagtgctatggtaattattgtcacaggatttaggatgattaataatagttcggaccacaaataaacagctttaagaagttcaactttcccccacggatagcaaatttggttggaccatctttgatgaaagtccccaatctcataattgccaaccttttttatacgaaactagtattttcataattatcaagaatcttcaactcatcagtgatcgctcatttctgattaagaaaaaaaaagggtgagtaaatgaatccattttgtctgttctccatggatctcgacccgggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattctagtggccggcccagctgatatcatgtcgtgcttagcacgtgatgcatcatagatgcggtaaattattactttctgtgactgggacaatgtgctcctccagtggccacgtatcggtaaaccttgtgccagaacactaatatttatataatcaacaataaagaatggtaagcattagacaaagacaaaaacaatttttaataatttacctgtactaattagaaggggtttgatttaattttattaaacttaacatgtgcaatatgtccctttgtttagaggaaaacaattacggtatttccttactaacgtaaactctgaatataatcatacatctgtattctgaaaaagaaaaaagaactagagataaaagcgtagaaacaacagtatgtggtcatagtcatacacgtaaagggatgaaaattgaaaatagaacctgcaggaaataagtttgcatttaatttggatatatatcttgaagtgtaaggttaacctctcagctattaaatagtactactactaacactcaaatagtacttctactagcactcacggtaacaatctcttagtagggatgggaataggccagatcggcctacaggggtctacgacttgacttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattggtgctaagcacgacatccagttttagagctagaaatagcaagttaaaataaggctagtccgttatcaacttgaaaaagtggcaccgagtcggtgcttttttttcggaccgggttaccagtctaaaaacggcccctaactaacgcttagttgcccgctagattagtcccccgttagtgcctagttagacacacgacgaactaggggctactagtagcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcacctaaaaagaagaggaaagttatggacaaaaagtactccatagggctcgatatcggcacaaacagtgtggggtgggcagtcatcactgacgactacaaggtcccctccaagaagttcaaggtcctcggcaatacagaccgccactccatcaagaagaacctcatcggagcactgttgttcgactccggagaaactgccgaagcaaccagactcaagaggaccgccagaagaaggtacacaaggcgcaagaacaggatctgctacctccaggagatcttcagtaacgagatggcaaaggtcgacgactctttcttccacaggctcgaggaatccttcctcgtcgaggaggacaagaagcatgagagacaccccatcttcggaaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtcgcctaccacgagaagtacccaaccatctaccacctgaggaagaagctcgtcgacagtaccgacaaggctgacctcaggctcatctacctcgcactcgcccacatgattaagttcaggggccacttcctcatagagggagacctcaacccagacaactccgacgtcgacaaactcttcatccaactcgtgcagacctacaatcaactctttgaagagaacccaatcaacgcctccggagtggatgctaaggctatattgtccgccaggctctccaaatcaagacgcctcgaaaacctcatcgcccagctcccaggggagaagaaaaatagcctcttcgggaacctcatagccctgtcccttggactcacccctaacttcaaatcaaatttcgacctcgcagaggacgctaagcttcaactctccaaggacacctacgacgacgacctcgataacctcctcgcccaaatcggtgatcaatacgctgacctcttcctcgctgctaagaacctctccgacgccatactcctctccgacattctgagggtcaacaccgagatcacaaaggctcccttgtccgcctccatgattaaacgctacgacgaacaccaccaggacctcaccctcttgaaggcactggttagacagcagctccccgagaagtacaaggaaatcttcttcgaccaatcaaaaaacggctacgccggatacatcgacggaggagcatcccaggaagagttctacaagttcatcaaaccaattctcgaaaagatggacggaacagaggagctcttggtcaagctcaacagggaggacctcctcagaaagcagagaaccttcgacaacggcagtatcccccaccagatccaccttggagagttgcacgcaatcctcaggaggcaagaggacttctaccccttcctcaaggacaacagggagaagatcgagaagatccttacattccgcatcccctactacgtcggacctttggcaagaggaaactcccgcttcgcatggatgactcgcaagagtgaggaaaccatcaccccttggaacttcgaggaggtcgtcgataagggagcttcagcccagtccttcatcgagcgcatgaccaacttcgataaaaatctccccaatgaaaaagtcctccccaagcacagtctgctctacgagtacttcacagtctacaacgagctcaccaaggtcaagtacgtcaccgaaggcatgagaaaacccgccttcctcagtggcgagcagaagaaggcaatcgtggacttgctgttcaagaccaaccgcaaggtcacagtcaagcaattaaaagaggactacttcaagaaaatagagtgcttcgacagtgtcgagatctctggggtcgaggacaggttcaacgcatccttggggacctatcacgacctcctcaagatcattaaagacaaggacttcctcgacaacgaggagaacgaggacatactggaggacatcgtcctcaccctcactctctttgaggacagggagatgatagaggagcgcctcaaaacctacgcccacctcttcgacgacaaggtgatgaaacagctcaagaggcgcagatacaccggatggggtagactctccaggaagctgattaatggcatccgcgacaaacagtccggcaagaccatcctcgacttcctcaagagtgacggattcgccaaccgcaacttcatgcagctcatacacgacgactccctcaccttcaaggaggacatccaaaaagcccaagtctccggacagggagactcattgcacgaacacatcgccaacttggctggatctcctgctattaaaaagggcatcctccaaaccgtcaaggtggtcgacgaactcgtcaaggtcatgggtagacacaagcccgaaaatatcgtcatcgagatggcaagggagaaccagacaacccagaagggccaaaaaaactccagggagcgcatgaaacgcatcgaggagggaataaaggagctcgggtcccagatcctcaaggagcaccccgtcgaaaatactcaactccagaatgaaaagctctacctctactacctccaaaacggcagggatatgtacgtcgaccaagagctcgacattaatcgcctctccgactacgacgtcgatcacatcgtcccccagagtttcctcaaggacgactccatcgacaacaaggtcctcaccagatccgataaaaatcgcggaaagtccgacaacgtcccctctgaggaagtggttaagaagatgaaaaactactggagacagctcctcaacgcaaagctgatcacccagcgcaagttcgacaacctcacaaaggctgagagagggggactctctgagttggacaaggccggcttcatcaagagacaactcgtggaaacccgccagatcaccaagcatgtcgcacagattctcgactcccgcatgaatactaaatacgatgaaaatgacaagctcatcagggaggtcaaggtcatcaccctgaagtccaagctcgtctccgacttccgcaaggacttccagttctacaaggtccgcgagatcaacaactaccaccacgcccacgacgcatacctcaacgctgtggttggaacagcactcatcaagaagtaccccaagctcgagtccgagttcgtctacggcgactacaaggtctacgacgtcaggaagatgatcgccaagtccgagcaagagatcggaaaggccaccgcaaaatatttcttctactccaacataatgaacttcttcaaaaccgagatcaccctggctaacggagaaataaggaagaggcccctgatagaaaccaacggcgagacaggcgagattgtctgggacaaaggcagggacttcgcaaccgtcagaaaggtgctcagtatgcctcaggtcaacatagtcaaaaagaccgaagtccagactggaggattctccaaggagtccatcctccccaaaaggaactccgacaaactgatcgccaggaaaaaggactgggaccccaaaaaatatggcggcttcgactcccctactgttgcttacagtgtgctcgtcgtcgcaaaagtcgagaaggggaaatccaagaagctcaagtcagtgaaggagctcctcggcatcaccatcatggagaggtcctccttcgagaagaaccccatcgacttcctcgaggccaagggatataaggaggtcaagaaggacctcatcattaaactccccaagtactccctcttcgagctcgaaaacggacgcaagaggatgctcgcttcagctggtgaactccagaagggcaacgaactcgctttgccctctaaatacgtcaacttcctctacctcgcctcccactatgaaaagctcaagggctccccagaggacaacgagcagaagcaactcttcgtcgagcagcacaagcattacctcgacgagatcatcgagcagatctccgagttctccaagagagtcatcctcgctgacgcaaacctcgacaaggtcctcagtgcatataacaagcaccgcgacaaaccaataagggagcaggccgaaaatattatacacctgttcaccctcaccaacttgggagcaccagccgccttcaagtatttcgacaccaccatcgacagaaagcgctacacctccacaaaggaggtcctggacgccacacttatccaccagtccatcaccggcctctatgaaacacgcatcgacctctctcaattgggaggggacaagagaccaagagacagacacgatggagagcttggaggtagaaagagagcaaggtagttcgaactggccaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttggcgcgccgttaacttaacggcaaacgctaattagtcactaggcccaggaaacactaactaagccctagcttatcctagcgcaacctagttaggtcttggtaacccgaaatctagtctaggtgtgttttgcgatccgatatcgatgcggccgcatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagccatggctgcaactactcttacatctgctttacctggtgctttcagttcatcccagagaccaagtgctcctttcaacttacaaagatcacctagagtgcttagaaggttcaacagaaagacaggacgtcaacctcgtggacttgttcgtgctgcaaaggctcaagcggcgcaaaacctgccagagaaattcgatgaaacaagactctgggaggccctcaggggatttggggttagtccaagtagggttacttacgctcccgtcggattcggagattaccactggaccgtcacagatgaagacgggagaccttggttcgcaactgtcagtgacctcgaacacaaagagcattgcgggcagggagcacaagcagcccttaaaggactcagacaagctatggacactgccctcgcacttagagatagggacggactcagattcgtggttgctccagtggcagcaacagatgggggtggccctgtccttccccttgacgctaggtatgcactcacagtcttccctcacgtcccaggaagaacaggagagttcggacaaagactcacagaggcagagagggacagactgcttgctcttctggcagaactccacggaagaacacctcctgaaacaaccccaccagccgatatggaaccaccaggacttcctggtgttagagcagcactcgccgaaagtgaaggaccttggagtggaggaccatttgcagaacccgctagacttcttctcagagaacacgaggccacactgcacgcaagactcgctgaattcgaagccctcgtcgcaagagttaagggtcgtggagcacctcttgtcgttacccacggagaaccacacccaggcaacttgatcctcggagaggaaggctatctcctcgtggactgggatacagttggactggctccagctgaaagggatttgagtctcatctcagacgacccagctgacctcgcaagatacgcagagcttacaggaagaactccagacccagacgcactcgcactctatagactgcgttggagtctccttgatgtggctgagttcgtcgagtggttcagggctgaacaccaaagaacccaagacaccgagagtgcatggaaggggttcactgacacacttgggcaattggctgctggtggatcagctgcatagcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagaggtaccggcggccgcgggcaactttattatacaaagttgatagatatcggtccgacggccagaatggccatctggattcagcaggcctagaaggccatttagtcctagcgatcgcgctgacaagcggtatttaaatcatcattctaggcgcgccacttacgcttgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccaaacgtgcaagcgctactagacaattcagtacattaaaaacgtccgcaatgtgttattaagttgtctaagcgtcaatttatttacaattgaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggcgcgcgcggtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttattttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaacgcgcgcgggcgcgccttttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatggcgcgccggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggggaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtaggaacagtgaattggagttcgtcttgttataattagcttcttgggggatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatacttcgctcgtgaaaagcagcgctcagggggctagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtacgttggaatcgcttctacaaaa

SEQ ID NO: 57 - DNA, 27655 bp, Artificial
  Vector 12
tcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtacgttggaatcgcttctacaaaactcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaacgaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacctagctaggttaccagagctggtcaccttcttcatcgctaagaagacactcagtagtccggaccgatatcgctatcaactttgtatagaaaagttgggccgaattcgagctcggtacggccagaatggcccggaccgaagcttgcatgcggatccccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttggtgctaagcacgacatccagttttagagctagaaatagcaagttaaaataaggctagtccgttatcaacttgaaaaagtggcaccgagtcggtgctttttttactagtcctgcaggggcgcgccggtcacccggtccgggcctagaaggccacccagctttcttgtacaaagtggggatcggccagaatggcccggaccgggttaccagtctaaaaacggcccctaactaacgcttagttgcccgctagattagtcccccgttagtgcctagttagacacacgacgaactaggggctactagtagcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcacctaaaaagaagaggaaagttatggacaaaaagtactccatagggctcgatatcggcacaaacagtgtggggtgggcagtcatcactgacgactacaaggtcccctccaagaagttcaaggtcctcggcaatacagaccgccactccatcaagaagaacctcatcggagcactgttgttcgactccggagaaactgccgaagcaaccagactcaagaggaccgccagaagaaggtacacaaggcgcaagaacaggatctgctacctccaggagatcttcagtaacgagatggcaaaggtcgacgactctttcttccacaggctcgaggaatccttcctcgtcgaggaggacaagaagcatgagagacaccccatcttcggaaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtcgcctaccacgagaagtacccaaccatctaccacctgaggaagaagctcgtcgacagtaccgacaaggctgacctcaggctcatctacctcgcactcgcccacatgattaagttcaggggccacttcctcatagagggagacctcaacccagacaactccgacgtcgacaaactcttcatccaactcgtgcagacctacaatcaactctttgaagagaacccaatcaacgcctccggagtggatgctaaggctatattgtccgccaggctctccaaatcaagacgcctcgaaaacctcatcgcccagctcccaggggagaagaaaaatagcctcttcgggaacctcatagccctgtcccttggactcacccctaacttcaaatcaaatttcgacctcgcagaggacgctaagcttcaactctccaaggacacctacgacgacgacctcgataacctcctcgcccaaatcggtgatcaatacgctgacctcttcctcgctgctaagaacctctccgacgccatactcctctccgacattctgagggtcaacaccgagatcacaaaggctcccttgtccgcctccatgattaaacgctacgacgaacaccaccaggacctcaccctcttgaaggcactggttagacagcagctccccgagaagtacaaggaaatcttcttcgaccaatcaaaaaacggctacgccggatacatcgacggaggagcatcccaggaagagttctacaagttcatcaaaccaattctcgaaaagatggacggaacagaggagctcttggtcaagctcaacagggaggacctcctcagaaagcagagaaccttcgacaacggcagtatcccccaccagatccaccttggagagttgcacgcaatcctcaggaggcaagaggacttctaccccttcctcaaggacaacagggagaagatcgagaagatccttacattccgcatcccctactacgtcggacctttggcaagaggaaactcccgcttcgcatggatgactcgcaagagtgaggaaaccatcaccccttggaacttcgaggaggtcgtcgataagggagcttcagcccagtccttcatcgagcgcatgaccaacttcgataaaaatctccccaatgaaaaagtcctccccaagcacagtctgctctacgagtacttcacagtctacaacgagctcaccaaggtcaagtacgtcaccgaaggcatgagaaaacccgccttcctcagtggcgagcagaagaaggcaatcgtggacttgctgttcaagaccaaccgcaaggtcacagtcaagcaattaaaagaggactacttcaagaaaatagagtgcttcgacagtgtcgagatctctggggtcgaggacaggttcaacgcatccttggggacctatcacgacctcctcaagatcattaaagacaaggacttcctcgacaacgaggagaacgaggacatactggaggacatcgtcctcaccctcactctctttgaggacagggagatgatagaggagcgcctcaaaacctacgcccacctcttcgacgacaaggtgatgaaacagctcaagaggcgcagatacaccggatggggtagactctccaggaagctgattaatggcatccgcgacaaacagtccggcaagaccatcctcgacttcctcaagagtgacggattcgccaaccgcaacttcatgcagctcatacacgacgactccctcaccttcaaggaggacatccaaaaagcccaagtctccggacagggagactcattgcacgaacacatcgccaacttggctggatctcctgctattaaaaagggcatcctccaaaccgtcaaggtggtcgacgaactcgtcaaggtcatgggtagacacaagcccgaaaatatcgtcatcgagatggcaagggagaaccagacaacccagaagggccaaaaaaactccagggagcgcatgaaacgcatcgaggagggaataaaggagctcgggtcccagatcctcaaggagcaccccgtcgaaaatactcaactccagaatgaaaagctctacctctactacctccaaaacggcagggatatgtacgtcgaccaagagctcgacattaatcgcctctccgactacgacgtcgatcacatcgtcccccagagtttcctcaaggacgactccatcgacaacaaggtcctcaccagatccgataaaaatcgcggaaagtccgacaacgtcccctctgaggaagtggttaagaagatgaaaaactactggagacagctcctcaacgcaaagctgatcacccagcgcaagttcgacaacctcacaaaggctgagagagggggactctctgagttggacaaggccggcttcatcaagagacaactcgtggaaacccgccagatcaccaagcatgtcgcacagattctcgactcccgcatgaatactaaatacgatgaaaatgacaagctcatcagggaggtcaaggtcatcaccctgaagtccaagctcgtctccgacttccgcaaggacttccagttctacaaggtccgcgagatcaacaactaccaccacgcccacgacgcatacctcaacgctgtggttggaacagcactcatcaagaagtaccccaagctcgagtccgagttcgtctacggcgactacaaggtctacgacgtcaggaagatgatcgccaagtccgagcaagagatcggaaaggccaccgcaaaatatttcttctactccaacataatgaacttcttcaaaaccgagatcaccctggctaacggagaaataaggaagaggcccctgatagaaaccaacggcgagacaggcgagattgtctgggacaaaggcagggacttcgcaaccgtcagaaaggtgctcagtatgcctcaggtcaacatagtcaaaaagaccgaagtccagactggaggattctccaaggagtccatcctccccaaaaggaactccgacaaactgatcgccaggaaaaaggactgggaccccaaaaaatatggcggcttcgactcccctactgttgcttacagtgtgctcgtcgtcgcaaaagtcgagaaggggaaatccaagaagctcaagtcagtgaaggagctcctcggcatcaccatcatggagaggtcctccttcgagaagaaccccatcgacttcctcgaggccaagggatataaggaggtcaagaaggacctcatcattaaactccccaagtactccctcttcgagctcgaaaacggacgcaagaggatgctcgcttcagctggtgaactccagaagggcaacgaactcgctttgccctctaaatacgtcaacttcctctacctcgcctcccactatgaaaagctcaagggctccccagaggacaacgagcagaagcaactcttcgtcgagcagcacaagcattacctcgacgagatcatcgagcagatctccgagttctccaagagagtcatcctcgctgacgcaaacctcgacaaggtcctcagtgcatataacaagcaccgcgacaaaccaataagggagcaggccgaaaatattatacacctgttcaccctcaccaacttgggagcaccagccgccttcaagtatttcgacaccaccatcgacagaaagcgctacacctccacaaaggaggtcctggacgccacacttatccaccagtccatcaccggcctctatgaaacacgcatcgacctctctcaattgggaggggacaagagaccaagagacagacacgatggagagcttggaggtagaaagagagcaaggtagttcgaactggccaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttggcgcgccgttaacttaacggcaaacgctaattagtcactaggcccaggaaacactaactaagccctagcttatcctagcgcaacctagttaggtcttggtaacccggtccgggccattctggccgatcccgggcaactttattatacaaagttgatagatatcggtccgacggccagaatggccatctggattcagcaggcctagaaggccatttagtcctagcgatatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagccatggctgcaactactcttacatctgctttacctggtgctttcagttcatcccagagaccaagtgctcctttcaacttacaaagatcacctagagtgcttagaaggttcaacagaaagacaggacgtcaacctcgtggacttgttcgtgctgcaaaggctcaagcggcgcaaaacctgccagagaaattcgatgaaacaagactctgggaggccctcaggggatttggggttagtccaagtagggttacttacgctcccgtcggattcggagattaccactggaccgtcacagatgaagacgggagaccttggttcgcaactgtcagtgacctcgaacacaaagagcattgcgggcagggagcacaagcagcccttaaaggactcagacaagctatggacactgccctcgcacttagagatagggacggactcagattcgtggttgctccagtggcagcaacagatgggggtggccctgtccttccccttgacgctaggtatgcactcacagtcttccctcacgtcccaggaagaacaggagagttcggacaaagactcacagaggcagagagggacagactgcttgctcttctggcagaactccacggaagaacacctcctgaaacaaccccaccagccgatatggaaccaccaggacttcctggtgttagagcagcactcgccgaaagtgaaggaccttggagtggaggaccatttgcagaacccgctagacttcttctcagagaacacgaggccacactgcacgcaagactcgctgaattcgaagccctcgtcgcaagagttaagggtcgtggagcacctcttgtcgttacccacggagaaccacacccaggcaacttgatcctcggagaggaaggctatctcctcgtggactgggatacagttggactggctccagctgaaagggatttgagtctcatctcagacgacccagctgacctcgcaagatacgcagagcttacaggaagaactccagacccagacgcactcgcactctatagactgcgttggagtctccttgatgtggctgagttcgtcgagtggttcagggctgaacaccaaagaacccaagacaccgagagtgcatggaaggggttcactgacacacttgggcaattggctgctggtggatcagctgcatagcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagagaattcgtgaaatggaacgtgtgtgatgggtacaagttgcttgtggtgtatcatgtatgagtataaaatttagctcaaataacttatcattgaacggacttagttatacttttttttttttttatctttctaatacatatatttcgttgttataaaagtagaaatgttcgatttctgtaaaattatcgttgatttttcttccacgtaaaataaaattaaaatatgttatatttttagaacataacaagattcgtgtaaatttaaatttgtgagaatttctaaaaatcaattaaaaatcatcacaaattacagaaaaaccatcataaattatagaataaaaataaatacaaatacaaattatgatggtttttaacctcaaacttaaatcttaaatatatttttaacctttaaagatatgattttttggagggcaaaaatatgacctttcttcaaagtagtccatttgtttgtatttattattaattgtaaatattatttttagcaccaaaatatcttggcataaaattaaaacacacattttttttctaaggtaaacattaaaaaaagaactcattccaaaaaagtaacatgtttcaaaaaatccaaaaacatttaaattttaaaataattctagtaatagtatttatatttaatattaaaactcacaaataaatgagattgcccgttttatataaaattgggatgagtaaatatgtatgatacaattatataaggacaattaagtataattatgtgtgcatgttaaagttgatttaattaaataagatgcgtaaattattataacttttttttaacatttatacttgctaacacaccccatattcacatgataataggaggcatctctaatgagttgatatttttacacgagagtgatgagtaagtttgaattatgcaatcataaatagtaaaatttaacaatcaatatttatttaccttatttgtaagtgaaaaaaaatatttgtatatatattataatttaaagtataaatgaatttaaatgaaatattaggctgtgaaattaatcataagattcacaaataagaatctagatgaattaattaatacccatagtgaaaaatagtggtctcattaagaaaaaaattgaaaactcaagtttatgttgtgcacttttgctatgtaagagagaggaaaggattaaaatgaaatgagcaagctttataaaaaaatataaatttaaaaaaaaaaaaaaaaaaaaagcacgaggtagagtagaatgattgcatgagtggcacatggtgacaaattcgagacagatattttcacacctttccatcacatcaactctcccccgttgatcatcatttaatatctcatccaacggcaaacaaacgtacattttagaacataccagaaaatccctctctctcatcaatccacccaagtgatgaaaacgacgtcgacgtgggagaagatccgcaaacggattagacgcgtcgtcagatttcgacacgtgtacggtggatgtttcggactctctcccctcaaccgctttataaattggggtcgtggcttcgccttgaaactcgttctagtgtatgtgattgttgtgactcgttcttcttcgtcgttatcttcttcttttgttgtttgtgtgtttgttttttctctcacctgtaaggatccgccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgacgaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagttttgtgatctgatgataagtggttggttcgtgtctcatgcacttgggaggtgatctatttcacctggtgtagtttgtgtttccgtcagttggaaaaacttatccctatcgatttcgttttcattttctgcttttcttttatgtaccttcgtttgggcttgtaacgggcctttgtatttcaactctcaataataatccaagtgcatgttaaacaatttgtcatctgtttcggctttgatatactactggtgaagatgggccgtactactgcatcacaacgaaaaataataataagatgaaaaacttgaagtggaaaaaaaaaaaacttgaatgttcactactactcattgaccataatgtttaacatacatagctcaatagtatttttgtgaatatggcaacacaaacagtccaaaacaattgtctcttactataccaaaccaagggcgccgcttgtttgccactctttgtgtgcaatagtgtgattaccacatctccacattcaatatattccctgaattatctgacgattttgatggctcactgttttcccaagtcttgaattgtcttctgtgcgccagtcaaatgcatatgtgttgagtttatcttttaaatatcaagcttttgtttttaacttttgtttgtaaccaaaaactcacagtaggagtttgatcacataattttatgtttgcctttgcaatttctagtgagtctttgattaaaagcttgaaaagaaaatgcagccaagcttaccaagtaagttatgtgtattaaccagaggaagagagaatcttgcaaaatttcaacaaacacaaaaagaagtattactacgattggtggagaaagaaaacgattccaaatcttgaactgttgttgtaaaagcatagcagaaagtgggagacaaccgaaatagaaatgactataacttaatttaatgttatcattataatttcttctagcaaatatttagaaagtaaatatcacatcaacctttaatgtaattaagctttctctttttgattcatgtgagatgaaaagaaaaaaaagaagagaaaagtgtagaaaacacatcatttctaagctgaagccacttacgcttgattccgatgacttcgtaggttcctagctcaagccgctcgtgtccaagcgtcacttacgattagctaatgattacggcatctaggaccgactagcggtacgctcgagcggtaagtgactagggtcacgtgaccctagtcacttaaattcggccagaatggccatctggattcagcaggcctagaaggcccggaccgattaaactttaattcggtccgggttacctctagaaagcttgtcgagcggtgctaagcacgacatccatggcgaccccagtgatggcaactaagtggatcaacagcaacttttgctccgatttgcgatataatttgtcaaaacatgcctctaaaatcactctaacatcaaatttcttgaataacaattttatacactcccctcctccaacttgttatgtgcccttctgacccttcttgttttgtttgctagttaaccatgtaggaaaaagtatcactccactcaatagtattttcacttcatctggccataaataattttggcctaattcagcatcacgtatcaggagtcaataagcttgtctgtccgtctgtatttatcatctctcttcgtgctactatcacctccccttttcttatggatttttcctgttaaaaaacaaaaaggaacaggtaacccacttgaattaggacaccaatgtaggtgccaccacccgtttccttctgttgagtgtgcacgcttattggttcaacctcagaattaaattcttcataatcccctgttgagagaaaattataatagacaaatcaaattgtgtggacttgccatttcccaaaacattttcattttgtgcgcgtgtgggtggtggggtgcgttttattagaatgaagactgtaaaaaagaggagtgtaggatgataagaagtagtaaatgtcagttgtcaaaagatgaaaagcaacggaggaagggaccaaaccttgacctatggaaaactgagtgctatggtaattattgtcacaggatttaggatgattaataatagttcggaccacaaataaacagctttaagaagttcaactttcccccacggatagcaaatttggttggaccatctttgatgaaagtccccaatctcataattgccaaccttttttatacgaaactagtattttcataattatcaagaatcttcaactcatcagtgatcgctcatttctgattaagaaaaaaaaagggtgagtaaatgaatccattttgtctgttctccatgggtcgagtaatactagtggtcacctaagtgactagggtcacgtgaccctagtcacttattcccaaacactagtaacggccgccagtgtgctggaattcgcccttcccaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataacaacagaagttcctattccgaagttcctattctctagaaagtataggaacttccactagtccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgacccgggccctaggaggccggcccagctgatgatcccggtgaagttcctattccgaagttcctattctccagaaagtataggaacttcactagagcttgcggccgctcgagcggtaagtgactagggtcacgtgaccctagtcacttaaattcggccagaatggccatctggattcagcaggcctagaaggcccggaccgattaaactttaattcggtccgggttacctctagaaagcttgtcgacatgtcgtgcttagcacgtgatgcatcatagatgcggtaaattattactttctgtgactgggacaatgtgctcctccagtggccacgtatcggtaaaccttgtgccagaacactaatatttatataatcaacaataaagaatggtaagcattagacaaagacaaaaacaatttttaataatttacctgtactaattagaaggggtttgatttaattttattaaacttaacatgtgcaatatgtccctttgtttagaggaaaacaattacggtatttccttactaacgtaaactctgaatataatcatacatctgtattctgaaaaagaaaaaagaactagagataaaagcgtagaaacaacagtatgtggtcatagtcatacacgtaaagggatgaaaattgaaaatagaacctgcaggaaataagtttgcatttaatttggatatatatcttgaagtgtaaggttaacctctcagctattaaatagtactactactaacactcaaatagtacttctactagcactcacggtaacaatctcttagtagggatgggaataggccagatcggcctacaggggtctacgacttgaggtgctaagcacgacatccatggatcgtaccattcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccaaacgtgcaagcgctactagacaattcagtacattaaaaacgtccgcaatgtgttattaagttgtctaagcgtcaatttatttacaattgaatatatcctgccattaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggggcccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctgggcggcctggccgcccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatggcgcgccggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtaggaacagtgaattggagttcgtcttgttataattagcttcttgggggatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatacttcgctcgtgaaaagcagcgctcagggggctagtgcgctcttccgcttcctcgctcactgactcgctgcgctcggtcgt

SEQ ID NO: 58 - DNA, 24231 bp, Artificial
  Vector 13
tcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtacgttggaatcgcttctacaaaactcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaacgaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacctagctaggttaccagagctggtcaccttcttcatcgctaagaagacactcagtagtccggaccgatatcgctatcaactttgtatagaaaagttgggccgaattcgagctcggtacggccagaatggcccggaccgaagcttgcatgcggatccccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgcaaccacagctgctgtcaagttttagagctagaaatagcaagttaaaataaggctagtccgttatcaacttgaaaaagtggcaccgagtcggtgctttttttactagtcctgcaggggcgcgccggtcacccggtccgggcctagaaggccacccagctttcttgtacaaagtggggatcggccagaatggcccggaccgggttaccagtctaaaaacggcccctaactaacgcttagttgcccgctagattagtcccccgttagtgcctagttagacacacgacgaactaggggctactagtagcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcacctaaaaagaagaggaaagttatggacaaaaagtactccatagggctcgatatcggcacaaacagtgtggggtgggcagtcatcactgacgactacaaggtcccctccaagaagttcaaggtcctcggcaatacagaccgccactccatcaagaagaacctcatcggagcactgttgttcgactccggagaaactgccgaagcaaccagactcaagaggaccgccagaagaaggtacacaaggcgcaagaacaggatctgctacctccaggagatcttcagtaacgagatggcaaaggtcgacgactctttcttccacaggctcgaggaatccttcctcgtcgaggaggacaagaagcatgagagacaccccatcttcggaaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtcgcctaccacgagaagtacccaaccatctaccacctgaggaagaagctcgtcgacagtaccgacaaggctgacctcaggctcatctacctcgcactcgcccacatgattaagttcaggggccacttcctcatagagggagacctcaacccagacaactccgacgtcgacaaactcttcatccaactcgtgcagacctacaatcaactctttgaagagaacccaatcaacgcctccggagtggatgctaaggctatattgtccgccaggctctccaaatcaagacgcctcgaaaacctcatcgcccagctcccaggggagaagaaaaatagcctcttcgggaacctcatagccctgtcccttggactcacccctaacttcaaatcaaatttcgacctcgcagaggacgctaagcttcaactctccaaggacacctacgacgacgacctcgataacctcctcgcccaaatcggtgatcaatacgctgacctcttcctcgctgctaagaacctctccgacgccatactcctctccgacattctgagggtcaacaccgagatcacaaaggctcccttgtccgcctccatgattaaacgctacgacgaacaccaccaggacctcaccctcttgaaggcactggttagacagcagctccccgagaagtacaaggaaatcttcttcgaccaatcaaaaaacggctacgccggatacatcgacggaggagcatcccaggaagagttctacaagttcatcaaaccaattctcgaaaagatggacggaacagaggagctcttggtcaagctcaacagggaggacctcctcagaaagcagagaaccttcgacaacggcagtatcccccaccagatccaccttggagagttgcacgcaatcctcaggaggcaagaggacttctaccccttcctcaaggacaacagggagaagatcgagaagatccttacattccgcatcccctactacgtcggacctttggcaagaggaaactcccgcttcgcatggatgactcgcaagagtgaggaaaccatcaccccttggaacttcgaggaggtcgtcgataagggagcttcagcccagtccttcatcgagcgcatgaccaacttcgataaaaatctccccaatgaaaaagtcctccccaagcacagtctgctctacgagtacttcacagtctacaacgagctcaccaaggtcaagtacgtcaccgaaggcatgagaaaacccgccttcctcagtggcgagcagaagaaggcaatcgtggacttgctgttcaagaccaaccgcaaggtcacagtcaagcaattaaaagaggactacttcaagaaaatagagtgcttcgacagtgtcgagatctctggggtcgaggacaggttcaacgcatccttggggacctatcacgacctcctcaagatcattaaagacaaggacttcctcgacaacgaggagaacgaggacatactggaggacatcgtcctcaccctcactctctttgaggacagggagatgatagaggagcgcctcaaaacctacgcccacctcttcgacgacaaggtgatgaaacagctcaagaggcgcagatacaccggatggggtagactctccaggaagctgattaatggcatccgcgacaaacagtccggcaagaccatcctcgacttcctcaagagtgacggattcgccaaccgcaacttcatgcagctcatacacgacgactccctcaccttcaaggaggacatccaaaaagcccaagtctccggacagggagactcattgcacgaacacatcgccaacttggctggatctcctgctattaaaaagggcatcctccaaaccgtcaaggtggtcgacgaactcgtcaaggtcatgggtagacacaagcccgaaaatatcgtcatcgagatggcaagggagaaccagacaacccagaagggccaaaaaaactccagggagcgcatgaaacgcatcgaggagggaataaaggagctcgggtcccagatcctcaaggagcaccccgtcgaaaatactcaactccagaatgaaaagctctacctctactacctccaaaacggcagggatatgtacgtcgaccaagagctcgacattaatcgcctctccgactacgacgtcgatcacatcgtcccccagagtttcctcaaggacgactccatcgacaacaaggtcctcaccagatccgataaaaatcgcggaaagtccgacaacgtcccctctgaggaagtggttaagaagatgaaaaactactggagacagctcctcaacgcaaagctgatcacccagcgcaagttcgacaacctcacaaaggctgagagagggggactctctgagttggacaaggccggcttcatcaagagacaactcgtggaaacccgccagatcaccaagcatgtcgcacagattctcgactcccgcatgaatactaaatacgatgaaaatgacaagctcatcagggaggtcaaggtcatcaccctgaagtccaagctcgtctccgacttccgcaaggacttccagttctacaaggtccgcgagatcaacaactaccaccacgcccacgacgcatacctcaacgctgtggttggaacagcactcatcaagaagtaccccaagctcgagtccgagttcgtctacggcgactacaaggtctacgacgtcaggaagatgatcgccaagtccgagcaagagatcggaaaggccaccgcaaaatatttcttctactccaacataatgaacttcttcaaaaccgagatcaccctggctaacggagaaataaggaagaggcccctgatagaaaccaacggcgagacaggcgagattgtctgggacaaaggcagggacttcgcaaccgtcagaaaggtgctcagtatgcctcaggtcaacatagtcaaaaagaccgaagtccagactggaggattctccaaggagtccatcctccccaaaaggaactccgacaaactgatcgccaggaaaaaggactgggaccccaaaaaatatggcggcttcgactcccctactgttgcttacagtgtgctcgtcgtcgcaaaagtcgagaaggggaaatccaagaagctcaagtcagtgaaggagctcctcggcatcaccatcatggagaggtcctccttcgagaagaaccccatcgacttcctcgaggccaagggatataaggaggtcaagaaggacctcatcattaaactccccaagtactccctcttcgagctcgaaaacggacgcaagaggatgctcgcttcagctggtgaactccagaagggcaacgaactcgctttgccctctaaatacgtcaacttcctctacctcgcctcccactatgaaaagctcaagggctccccagaggacaacgagcagaagcaactcttcgtcgagcagcacaagcattacctcgacgagatcatcgagcagatctccgagttctccaagagagtcatcctcgctgacgcaaacctcgacaaggtcctcagtgcatataacaagcaccgcgacaaaccaataagggagcaggccgaaaatattatacacctgttcaccctcaccaacttgggagcaccagccgccttcaagtatttcgacaccaccatcgacagaaagcgctacacctccacaaaggaggtcctggacgccacacttatccaccagtccatcaccggcctctatgaaacacgcatcgacctctctcaattgggaggggacaagagaccaagagacagacacgatggagagcttggaggtagaaagagagcaaggtagttcgaactggccaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttggcgcgccgttaacttaacggcaaacgctaattagtcactaggcccaggaaacactaactaagccctagcttatcctagcgcaacctagttaggtcttggtaacccggtccgggccattctggccgatcccgggcaactttattatacaaagttgatagatatcggtccgacggccagaatggccatctggattcagcaggcctagaaggccatttagtcctagcgatatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagccatggctgcaactactcttacatctgctttacctggtgctttcagttcatcccagagaccaagtgctcctttcaacttacaaagatcacctagagtgcttagaaggttcaacagaaagacaggacgtcaacctcgtggacttgttcgtgctgcaaaggctcaagcggcgcaaaacctgccagagaaattcgatgaaacaagactctgggaggccctcaggggatttggggttagtccaagtagggttacttacgctcccgtcggattcggagattaccactggaccgtcacagatgaagacgggagaccttggttcgcaactgtcagtgacctcgaacacaaagagcattgcgggcagggagcacaagcagcccttaaaggactcagacaagctatggacactgccctcgcacttagagatagggacggactcagattcgtggttgctccagtggcagcaacagatgggggtggccctgtccttccccttgacgctaggtatgcactcacagtcttccctcacgtcccaggaagaacaggagagttcggacaaagactcacagaggcagagagggacagactgcttgctcttctggcagaactccacggaagaacacctcctgaaacaaccccaccagccgatatggaaccaccaggacttcctggtgttagagcagcactcgccgaaagtgaaggaccttggagtggaggaccatttgcagaacccgctagacttcttctcagagaacacgaggccacactgcacgcaagactcgctgaattcgaagccctcgtcgcaagagttaagggtcgtggagcacctcttgtcgttacccacggagaaccacacccaggcaacttgatcctcggagaggaaggctatctcctcgtggactgggatacagttggactggctccagctgaaagggatttgagtctcatctcagacgacccagctgacctcgcaagatacgcagagcttacaggaagaactccagacccagacgcactcgcactctatagactgcgttggagtctccttgatgtggctgagttcgtcgagtggttcagggctgaacaccaaagaacccaagacaccgagagtgcatggaaggggttcactgacacacttgggcaattggctgctggtggatcagctgcatagcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagagaattcgtgaaatggaacgtgtgtgatgggtacaagttgcttgtggtgtatcatgtatgagtataaaatttagctcaaataacttatcattgaacggacttagttatacttttttttttttttatctttctaatacatatatttcgttgttataaaagtagaaatgttcgatttctgtaaaattatcgttgatttttcttccacgtaaaataaaattaaaatatgttatatttttagaacataacaagattcgtgtaaatttaaatttgtgagaatttctaaaaatcaattaaaaatcatcacaaattacagaaaaaccatcataaattatagaataaaaataaatacaaatacaaattatgatggtttttaacctcaaacttaaatcttaaatatatttttaacctttaaagatatgattttttggagggcaaaaatatgacctttcttcaaagtagtccatttgtttgtatttattattaattgtaaatattatttttagcaccaaaatatcttggcataaaattaaaacacacattttttttctaaggtaaacattaaaaaaagaactcattccaaaaaagtaacatgtttcaaaaaatccaaaaacatttaaattttaaaataattctagtaatagtatttatatttaatattaaaactcacaaataaatgagattgcccgttttatataaaattgggatgagtaaatatgtatgatacaattatataaggacaattaagtataattatgtgtgcatgttaaagttgatttaattaaataagatgcgtaaattattataacttttttttaacatttatacttgctaacacaccccatattcacatgataataggaggcatctctaatgagttgatatttttacacgagagtgatgagtaagtttgaattatgcaatcataaatagtaaaatttaacaatcaatatttatttaccttatttgtaagtgaaaaaaaatatttgtatatatattataatttaaagtataaatgaatttaaatgaaatattaggctgtgaaattaatcataagattcacaaataagaatctagatgaattaattaatacccatagtgaaaaatagtggtctcattaagaaaaaaattgaaaactcaagtttatgttgtgcacttttgctatgtaagagagaggaaaggattaaaatgaaatgagcaagctttataaaaaaatataaatttaaaaaaaaaaaaaaaaaaaaagcacgaggtagagtagaatgattgcatgagtggcacatggtgacaaattcgagacagatattttcacacctttccatcacatcaactctcccccgttgatcatcatttaatatctcatccaacggcaaacaaacgtacattttagaacataccagaaaatccctctctctcatcaatccacccaagtgatgaaaacgacgtcgacgtgggagaagatccgcaaacggattagacgcgtcgtcagatttcgacacgtgtacggtggatgtttcggactctctcccctcaaccgctttataaattggggtcgtggcttcgccttgaaactcgttctagtgtatgtgattgttgtgactcgttcttcttcgtcgttatcttcttcttttgttgtttgtgtgtttgttttttctctcacctgtaaggatccgccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgacgaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagttttgtgatctgatgataagtggttggttcgtgtctcatgcacttgggaggtgatctatttcacctggtgtagtttgtgtttccgtcagttggaaaaacttatccctatcgatttcgttttcattttctgcttttcttttatgtaccttcgtttgggcttgtaacgggcctttgtatttcaactctcaataataatccaagtgcatgttaaacaatttgtcatctgtttcggctttgatatactactggtgaagatgggccgtactactgcatcacaacgaaaaataataataagatgaaaaacttgaagtggaaaaaaaaaaaacttgaatgttcactactactcattgaccataatgtttaacatacatagctcaatagtatttttgtgaatatggcaacacaaacagtccaaaacaattgtctcttactataccaaaccaagggcgccgcttgtttgccactctttgtgtgcaatagtgtgattaccacatctccacattcaatatattccctgaattatctgacgattttgatggctcactgttttcccaagtcttgaattgtcttctgtgcgccagtcaaatgcatatgtgttgagtttatcttttaaatatcaagcttttgtttttaacttttgtttgtaaccaaaaactcacagtaggagtttgatcacataattttatgtttgcctttgcaatttctagtgagtctttgattaaaagcttgaaaagaaaatgcagccaagcttaccaagtaagttatgtgtattaaccagaggaagagagaatcttgcaaaatttcaacaaacacaaaaagaagtattactacgattggtggagaaagaaaacgattccaaatcttgaactgttgttgtaaaagcatagcagaaagtgggagacaaccgaaatagaaatgactataacttaatttaatgttatcattataatttcttctagcaaatatttagaaagtaaatatcacatcaacctttaatgtaattaagctttctctttttgattcatgtgagatgaaaagaaaaaaaagaagagaaaagtgtagaaaacacatcatttctaagctgaagccacttacgcttgattccgatgacttcgtaggttcctagctcaagccgctcgtgtccaagcgtcacttacgattagctaatgattacggcatctaggaccgactagcggtacggcaaccacagctgctgtcaaaggagataaaccctcccccaaaacacaaattagaatgacatttcaagttccatgtatgtcactttcattctattatttttacaacttttagttacttaacagatgtcttgttcagcataaattataatttattctgtttttttttagggaacaactgttgtagacaacttgttgtatagtgaggatattcattacatgcttggtgcattaaggacccttggactgcgtgtggaagatgacaaaacaaccaaacaagcaattgttgaaggctgtgggggattgtttcccactagtaaggaatctaaagatgaaatcaatttattccttggaaatgctggtattgcaatgagatctttgacagcagctgtggttgctgcaggtggaaatgcaaggtctgttttttttttttttgttcagcataatctttgaattgttcctcgtataactaatcacaacagagtacgtgttcttcttcctgttataatctaaaaatctcatccagattagtcatcctttcttcttaaaaggaacctttaattatcaatgtatttatttaatatttaaattagcttgtcaaagtctagcatatacatattttgattatattctgagaaatgcacctgagggtgttcctcatgatctacttcaacctctgttattattagattttctatcatgattactggtttgagtctctaagtagaccatcttgatgttcaaaatatttcagctacgtacttgatggggtgccccgaatgagagagaggccaattggggatttggttgctggtcttaagcaacttggtgcagatgttgattgctttcttggcacaaactgtccacctgttcgtgtaaatgggaagggaggacttcctggcggaaaggtatggtttggatttcatttagaataaggtggagtaactttcctggatcaaaattctaatttaagaagcctccctgttttcctctctttagaataagactaagggtaggtttaggagttgggttttggagagaaatggaagggagagcaatttttttcttcttctaataaatattctttaatttgatacattttttaagtaaaagaatataaagatagattagcataacttaatgttttaatcttttatttatttttataaatattatatacctgtctatttaaaaatcaaatatttgtcctccattccctttcccttcaaaacctcagttccaaatataccgtagttgaattatattttggaaggcctattggttggagacttttccttttcagagattatccctcacctttattatagcctttctatttttaaacttcatatagacgccattcttggggcaaccacagctgctgtcaaaggcgtaccattcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccaaacgtgcaagcgctactagacaattcagtacattaaaaacgtccgcaatgtgttattaagttgtctaagcgtcaatttatttacaattgaatatatcctgccattaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggggcccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctgggcggcctggccgcccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatggcgcgccggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtaggaacagtgaattggagttcgtcttgttataattagcttcttgggggatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatacttcgctcgtgaaaagcagcgctcagggggctagtgcgctcttccgcttcctcgctcactgactcgctgcgctcggtcgt

SEQ ID NO: 59 - DNA, 27300 bp, Artificial
  Vector 14
ctcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaacgaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacctagctaggttacctcgagggtgctaagcacgacatccatggcgaccccagtgatggcaactaagtggatcaacagcaacttttgctccgatttgcgatataatttgtcaaaacatgcctctaaaatcactctaacatcaaatttcttgaataacaattttatacactcccctcctccaacttgttatgtgcccttctgacccttcttgttttgtttgctagttaaccatgtaggaaaaagtatcactccactcaatagtattttcacttcatctggccataaataattttggcctaattcagcatcacgtatcaggagtcaataagcttgtctgtccgtctgtatttatcatctctcttcgtgctactatcacctccccttttcttatggatttttcctgttaaaaaacaaaaaggaacaggtaacccacttgaattaggacaccaatgtaggtgccaccacccgtttccttctgttgagtgtgcacgcttattggttcaacctcagaattaaattcttcataatcccctgttgagagaaaattataatagacaaatcaaattgtgtggacttgccatttcccaaaacattttcattttgtgcgcgtgtgggtggtggggtgcgttttattagaatgaagactgtaaaaaagaggagtgtaggatgataagaagtagtaaatgtcagttgtcaaaagatgaaaagcaacggaggaagggaccaaaccttgacctatggaaaactgagtgctatggtaattattgtcacaggatttaggatgattaataatagttcggaccacaaataaacagctttaagaagttcaactttcccccacggatagcaaatttggttggaccatctttgatgaaagtccccaatctcataattgccaaccttttttatacgaaactagtattttcataattatcaagaatcttcaactcatcagtgatcgctcatttctgattaagaaaaaaaaagggtgagtaaatgaatccattttgtctgttctccatggatctcgacccgggtaccctgggatccgatatcgatgggccctggccgaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataaccatgccacacaacacaatggcggccaccgcttccagaaccacccgattctcttcttcctcttcacaccccaccttccccaaacgcattactagatccaccctccctctctctcatcaaaccctcaccaaacccaaccacgctctcaaaatcaaatgttccatctccaaaccccccacggcggcgcccttcaccaaggaagcgccgaccacggagcccttcgtgtcacggttcgcctccggcgaacctcgcaagggcgcggacatccttgtggaggcgctggagaggcagggcgtgacgacggtgttcgcgtaccccggcggtgcgtcgatggagatccaccaggcgctcacgcgctccgccgccatccgcaacgtgctcccgcgccacgagcagggcggcgtcttcgccgccgaaggctacgcgcgttcctccggcctccccggcgtctgcattgccacctccggccccggcgccaccaacctcgtgagcggcctcgccgacgctttaatggacagcgtcccagtcgtcgccatcaccggccaggtcgcccgccggatgatcggcaccgacgccttccaagaaaccccgatcgtggaggtgagcagatccatcacgaagcacaactacctcatcctcgacgtcgacgacatcccccgcgtcgtcgccgaggctttcttcgtcgccacctccggccgccccggtccggtcctcatcgacattcccaaagacgttcagcagcaactcgccgtgcctaattgggacgagcccgttaacctccccggttacctcgccaggctgcccaggccccccgccgaggcccaattggaacacattgtcagactcatcatggaggcccaaaagcccgttctctacgtcggcggtggcagtttgaattccagtgctgaattgaggcgctttgttgaactcactggtattcccgttgctagcactttaatgggtcttggaacttttcctattggtgatgaatattcccttcagatgctgggtatgcatggtactgtttatgctaactatgctgttgacaatagtgatttgttgcttgcctttggggtaaggtttgatgaccgtgttactgggaagcttgaggcttttgctagtagggctaagattgttcacattgatattgattctgccgagattgggaagaacaagcaggcgcacgtgtcggtttgcgcggatttgaagttggccttgaagggaattaatatgattttggaggagaaaggagtggagggtaagtttgatcttggaggttggagagaagagattaatgtgcagaaacacaagtttccattgggttacaagacattccaggacgcgatttctccgcagcatgctatcgaggttcttgatgagttgactaatggagatgctattgttagtactggggttgggcagcatcaaatgtgggctgcgcagttttacaagtacaagagaccgaggcagtggttgacctcagggggtcttggagccatgggttttggattgcctgcggctattggtgctgctgttgctaaccctggggctgttgtggttgacattgatggggatggtagtttcatcatgaatgttcaggagttggccactataagagtggagaatctcccagttaagatattgttgttgaacaatcagcatttgggtatggtggttcagttggaggataggttctacaagtccaatagagctcacacctatcttggagatccgtctagcgagagcgagatattcccaaacatgctcaagtttgctgatgcttgtgggataccggcagcgcgagtgacgaagaaggaagagcttagagcggcaattcagagaatgttggacacccctggcccctaccttcttgatgtcattgtgccccatcaggagcatgtgttgccgatgattcccagtaatggatccttcaaggatgtgataactgagggtgatggtagaacgaggtactgattgcctagaccaaatgttccttgatgcttgttttgtacaatatatataagataatgctgtcctagttgcaggatttggcctgtggtgagcatcatagtctgtagtagttttggtagcaagacattttattttccttttatttaacttactacatgcagtagcatctatctatctctgtagtctgatatctcctgttgtctgtattgtgccgttggattttttgctgtagtgagactgaaaatgatgtgctagtaataatatttctgttagaaatctaagtagagaatctgttgaagaagtcaaaagctaatggaatcaggttacatattcaatgtttttctttttttagcggttggtagacgtgtagattcaacttctcttggagctcacctaggcaatcagtaaaatgcatattccttttttaacttgccatttatttacttttagtggaaattgtgaccaatttgttcatgtagaacggatttggaccattgcgtccacaaaacgtctcttttgctcgatcttcacaaagcgataccgaaatccagagatagttttcaaaagtcagaaatggcaaagttataaatagtaaaacagaatagatgctgtaatcgacttcaataacaagtggcatcacgtttctagttctagacccatcagctggggaattctagtggccggcccagctgatatcatgtcgtgcttagcacgtgatgcatcatagatgcggtaaattattactttctgtgactgggacaatgtgctcctccagtggccacgtatcggtaaaccttgtgccagaacactaatatttatataatcaacaataaagaatggtaagcattagacaaagacaaaaacaatttttaataatttacctgtactaattagaaggggtttgatttaattttattaaacttaacatgtgcaatatgtccctttgtttagaggaaaacaattacggtatttccttactaacgtaaactctgaatataatcatacatctgtattctgaaaaagaaaaaagaactagagataaaagcgtagaaacaacagtatgtggtcatagtcatacacgtaaagggatgaaaattgaaaatagaacctgcaggaaataagtttgcatttaatttggatatatatcttgaagtgtaaggttaacctctcagctattaaatagtactactactaacactcaaatagtacttctactagcactcacggtaacaatctcttagtagggatgggaataggccagatcggcctacaggggtctacgacttgaggtgctaagcacgacatccatggccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttggtgctaagcacgacatccagttttagagctagaaatagcaagttaaaataaggctagtccgttatcaacttgaaaaagtggcaccgagtcggtgcttttttttcggaccgggttaccagtctaaaaacggcccctaactaacgcttagttgcccgctagattagtcccccgttagtgcctagttagacacacgacgaactaggggctactagtagcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcacctaaaaagaagaggaaagttatggacaaaaagtactccatagggctcgatatcggcacaaacagtgtggggtgggcagtcatcactgacgactacaaggtcccctccaagaagttcaaggtcctcggcaatacagaccgccactccatcaagaagaacctcatcggagcactgttgttcgactccggagaaactgccgaagcaaccagactcaagaggaccgccagaagaaggtacacaaggcgcaagaacaggatctgctacctccaggagatcttcagtaacgagatggcaaaggtcgacgactctttcttccacaggctcgaggaatccttcctcgtcgaggaggacaagaagcatgagagacaccccatcttcggaaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtcgcctaccacgagaagtacccaaccatctaccacctgaggaagaagctcgtcgacagtaccgacaaggctgacctcaggctcatctacctcgcactcgcccacatgattaagttcaggggccacttcctcatagagggagacctcaacccagacaactccgacgtcgacaaactcttcatccaactcgtgcagacctacaatcaactctttgaagagaacccaatcaacgcctccggagtggatgctaaggctatattgtccgccaggctctccaaatcaagacgcctcgaaaacctcatcgcccagctcccaggggagaagaaaaatagcctcttcgggaacctcatagccctgtcccttggactcacccctaacttcaaatcaaatttcgacctcgcagaggacgctaagcttcaactctccaaggacacctacgacgacgacctcgataacctcctcgcccaaatcggtgatcaatacgctgacctcttcctcgctgctaagaacctctccgacgccatactcctctccgacattctgagggtcaacaccgagatcacaaaggctcccttgtccgcctccatgattaaacgctacgacgaacaccaccaggacctcaccctcttgaaggcactggttagacagcagctccccgagaagtacaaggaaatcttcttcgaccaatcaaaaaacggctacgccggatacatcgacggaggagcatcccaggaagagttctacaagttcatcaaaccaattctcgaaaagatggacggaacagaggagctcttggtcaagctcaacagggaggacctcctcagaaagcagagaaccttcgacaacggcagtatcccccaccagatccaccttggagagttgcacgcaatcctcaggaggcaagaggacttctaccccttcctcaaggacaacagggagaagatcgagaagatccttacattccgcatcccctactacgtcggacctttggcaagaggaaactcccgcttcgcatggatgactcgcaagagtgaggaaaccatcaccccttggaacttcgaggaggtcgtcgataagggagcttcagcccagtccttcatcgagcgcatgaccaacttcgataaaaatctccccaatgaaaaagtcctccccaagcacagtctgctctacgagtacttcacagtctacaacgagctcaccaaggtcaagtacgtcaccgaaggcatgagaaaacccgccttcctcagtggcgagcagaagaaggcaatcgtggacttgctgttcaagaccaaccgcaaggtcacagtcaagcaattaaaagaggactacttcaagaaaatagagtgcttcgacagtgtcgagatctctggggtcgaggacaggttcaacgcatccttggggacctatcacgacctcctcaagatcattaaagacaaggacttcctcgacaacgaggagaacgaggacatactggaggacatcgtcctcaccctcactctctttgaggacagggagatgatagaggagcgcctcaaaacctacgcccacctcttcgacgacaaggtgatgaaacagctcaagaggcgcagatacaccggatggggtagactctccaggaagctgattaatggcatccgcgacaaacagtccggcaagaccatcctcgacttcctcaagagtgacggattcgccaaccgcaacttcatgcagctcatacacgacgactccctcaccttcaaggaggacatccaaaaagcccaagtctccggacagggagactcattgcacgaacacatcgccaacttggctggatctcctgctattaaaaagggcatcctccaaaccgtcaaggtggtcgacgaactcgtcaaggtcatgggtagacacaagcccgaaaatatcgtcatcgagatggcaagggagaaccagacaacccagaagggccaaaaaaactccagggagcgcatgaaacgcatcgaggagggaataaaggagctcgggtcccagatcctcaaggagcaccccgtcgaaaatactcaactccagaatgaaaagctctacctctactacctccaaaacggcagggatatgtacgtcgaccaagagctcgacattaatcgcctctccgactacgacgtcgatcacatcgtcccccagagtttcctcaaggacgactccatcgacaacaaggtcctcaccagatccgataaaaatcgcggaaagtccgacaacgtcccctctgaggaagtggttaagaagatgaaaaactactggagacagctcctcaacgcaaagctgatcacccagcgcaagttcgacaacctcacaaaggctgagagagggggactctctgagttggacaaggccggcttcatcaagagacaactcgtggaaacccgccagatcaccaagcatgtcgcacagattctcgactcccgcatgaatactaaatacgatgaaaatgacaagctcatcagggaggtcaaggtcatcaccctgaagtccaagctcgtctccgacttccgcaaggacttccagttctacaaggtccgcgagatcaacaactaccaccacgcccacgacgcatacctcaacgctgtggttggaacagcactcatcaagaagtaccccaagctcgagtccgagttcgtctacggcgactacaaggtctacgacgtcaggaagatgatcgccaagtccgagcaagagatcggaaaggccaccgcaaaatatttcttctactccaacataatgaacttcttcaaaaccgagatcaccctggctaacggagaaataaggaagaggcccctgatagaaaccaacggcgagacaggcgagattgtctgggacaaaggcagggacttcgcaaccgtcagaaaggtgctcagtatgcctcaggtcaacatagtcaaaaagaccgaagtccagactggaggattctccaaggagtccatcctccccaaaaggaactccgacaaactgatcgccaggaaaaaggactgggaccccaaaaaatatggcggcttcgactcccctactgttgcttacagtgtgctcgtcgtcgcaaaagtcgagaaggggaaatccaagaagctcaagtcagtgaaggagctcctcggcatcaccatcatggagaggtcctccttcgagaagaaccccatcgacttcctcgaggccaagggatataaggaggtcaagaaggacctcatcattaaactccccaagtactccctcttcgagctcgaaaacggacgcaagaggatgctcgcttcagctggtgaactccagaagggcaacgaactcgctttgccctctaaatacgtcaacttcctctacctcgcctcccactatgaaaagctcaagggctccccagaggacaacgagcagaagcaactcttcgtcgagcagcacaagcattacctcgacgagatcatcgagcagatctccgagttctccaagagagtcatcctcgctgacgcaaacctcgacaaggtcctcagtgcatataacaagcaccgcgacaaaccaataagggagcaggccgaaaatattatacacctgttcaccctcaccaacttgggagcaccagccgccttcaagtatttcgacaccaccatcgacagaaagcgctacacctccacaaaggaggtcctggacgccacacttatccaccagtccatcaccggcctctatgaaacacgcatcgacctctctcaattgggaggggacaagagaccaagagacagacacgatggagagcttggaggtagaaagagagcaaggtagttcgaactggccaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttggcgcgccgttaacttaacggcaaacgctaattagtcactaggcccaggaaacactaactaagccctagcttatcctagcgcaacctagttaggtcttggtaacccgagatatcgatgcggccgccgctccgggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattctagtggccggcccagctgatatctagacccagctttcttgtacaaagtggcccggggcggccgaagctggccttctaggcccggaccgggtgaccaagcttggcgcgcccagggcccatcgatatcggtacctacgcgttcgaatatccatggatccgaattccgcggccgcttggtaacccggtccgggccattctggccgatccgttaacgcccgggcaactttattatacaaagttgatggtacggatccgtcgacggcgcgccgcggacctgaattccagcacactggcggccgttactagtaacggccgccagtgtgctggaattcgcccttcccaagctttgctctagatcaaactcacatccaaacataacatggatatcttccttaccaatcatactaattattttgggttaaatattaatcattatttttaagatattaattaataagtgactagggtcacgtgaccctagtcacttatgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccaaacgtgcaagcgctactagacaattcagtacattaaaaacgtccgcaatgtgttattaagttgtctaagcgtcaatttatttacaattgaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggcgcgcgcggtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaacgcgcgcgggcgcgccttttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatggcgcgccggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtaggaacagtgaattggagttcgtcttgttataattagcttcttgggggatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatacttcgctcgtgaaaagcagcgctcagggggctagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtacgttggaatcgcttctacaaaa

SEQ ID NO: 60 - DNA, 26875 bp, Artificial
  Vector 15
ctcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaacgaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacctagctaggttacctcgagggtgctaagcacgacatccatggcgaccccagtgatggcaactaagtggatcaacagcaacttttgctccgatttgcgatataatttgtcaaaacatgcctctaaaatcactctaacatcaaatttcttgaataacaattttatacactcccctcctccaacttgttatgtgcccttctgacccttcttgttttgtttgctagttaaccatgtaggaaaaagtatcactccactcaatagtattttcacttcatctggccataaataattttggcctaattcagcatcacgtatcaggagtcaataagcttgtctgtccgtctgtatttatcatctctcttcgtgctactatcacctccccttttcttatggatttttcctgttaaaaaacaaaaaggaacaggtaacccacttgaattaggacaccaatgtaggtgccaccacccgtttccttctgttgagtgtgcacgcttattggttcaacctcagaattaaattcttcataatcccctgttgagagaaaattataatagacaaatcaaattgtgtggacttgccatttcccaaaacattttcattttgtgcgcgtgtgggtggtggggtgcgttttattagaatgaagactgtaaaaaagaggagtgtaggatgataagaagtagtaaatgtcagttgtcaaaagatgaaaagcaacggaggaagggaccaaaccttgacctatggaaaactgagtgctatggtaattattgtcacaggatttaggatgattaataatagttcggaccacaaataaacagctttaagaagttcaactttcccccacggatagcaaatttggttggaccatctttgatgaaagtccccaatctcataattgccaaccttttttatacgaaactagtattttcataattatcaagaatcttcaactcatcagtgatcgctcatttctgattaagaaaaaaaaagggtgagtaaatgaatccattttgtctgttctccatggatctcgacccgggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattctagtggccggcccagctgatatcatgtcgtgcttagcacgtgatgcatcatagatgcggtaaattattactttctgtgactgggacaatgtgctcctccagtggccacgtatcggtaaaccttgtgccagaacactaatatttatataatcaacaataaagaatggtaagcattagacaaagacaaaaacaatttttaataatttacctgtactaattagaaggggtttgatttaattttattaaacttaacatgtgcaatatgtccctttgtttagaggaaaacaattacggtatttccttactaacgtaaactctgaatataatcatacatctgtattctgaaaaagaaaaaagaactagagataaaagcgtagaaacaacagtatgtggtcatagtcatacacgtaaagggatgaaaattgaaaatagaacctgcaggaaataagtttgcatttaatttggatatatatcttgaagtgtaaggttaacctctcagctattaaatagtactactactaacactcaaatagtacttctactagcactcacggtaacaatctcttagtagggatgggaataggccagatcggcctacaggggtctacgacttgaggtgctaagcacgacatccatggccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttggtgctaagcacgacatccagttttagagctagaaatagcaagttaaaataaggctagtccgttatcaacttgaaaaagtggcaccgagtcggtgcttttttttcggaccgggttaccagtctaaaaacggcccctaactaacgcttagttgcccgctagattagtcccccgttagtgcctagttagacacacgacgaactaggggctactagtagcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcacctaaaaagaagaggaaagttatggacaaaaagtactccatagggctcgatatcggcacaaacagtgtggggtgggcagtcatcactgacgactacaaggtcccctccaagaagttcaaggtcctcggcaatacagaccgccactccatcaagaagaacctcatcggagcactgttgttcgactccggagaaactgccgaagcaaccagactcaagaggaccgccagaagaaggtacacaaggcgcaagaacaggatctgctacctccaggagatcttcagtaacgagatggcaaaggtcgacgactctttcttccacaggctcgaggaatccttcctcgtcgaggaggacaagaagcatgagagacaccccatcttcggaaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtcgcctaccacgagaagtacccaaccatctaccacctgaggaagaagctcgtcgacagtaccgacaaggctgacctcaggctcatctacctcgcactcgcccacatgattaagttcaggggccacttcctcatagagggagacctcaacccagacaactccgacgtcgacaaactcttcatccaactcgtgcagacctacaatcaactctttgaagagaacccaatcaacgcctccggagtggatgctaaggctatattgtccgccaggctctccaaatcaagacgcctcgaaaacctcatcgcccagctcccaggggagaagaaaaatagcctcttcgggaacctcatagccctgtcccttggactcacccctaacttcaaatcaaatttcgacctcgcagaggacgctaagcttcaactctccaaggacacctacgacgacgacctcgataacctcctcgcccaaatcggtgatcaatacgctgacctcttcctcgctgctaagaacctctccgacgccatactcctctccgacattctgagggtcaacaccgagatcacaaaggctcccttgtccgcctccatgattaaacgctacgacgaacaccaccaggacctcaccctcttgaaggcactggttagacagcagctccccgagaagtacaaggaaatcttcttcgaccaatcaaaaaacggctacgccggatacatcgacggaggagcatcccaggaagagttctacaagttcatcaaaccaattctcgaaaagatggacggaacagaggagctcttggtcaagctcaacagggaggacctcctcagaaagcagagaaccttcgacaacggcagtatcccccaccagatccaccttggagagttgcacgcaatcctcaggaggcaagaggacttctaccccttcctcaaggacaacagggagaagatcgagaagatccttacattccgcatcccctactacgtcggacctttggcaagaggaaactcccgcttcgcatggatgactcgcaagagtgaggaaaccatcaccccttggaacttcgaggaggtcgtcgataagggagcttcagcccagtccttcatcgagcgcatgaccaacttcgataaaaatctccccaatgaaaaagtcctccccaagcacagtctgctctacgagtacttcacagtctacaacgagctcaccaaggtcaagtacgtcaccgaaggcatgagaaaacccgccttcctcagtggcgagcagaagaaggcaatcgtggacttgctgttcaagaccaaccgcaaggtcacagtcaagcaattaaaagaggactacttcaagaaaatagagtgcttcgacagtgtcgagatctctggggtcgaggacaggttcaacgcatccttggggacctatcacgacctcctcaagatcattaaagacaaggacttcctcgacaacgaggagaacgaggacatactggaggacatcgtcctcaccctcactctctttgaggacagggagatgatagaggagcgcctcaaaacctacgcccacctcttcgacgacaaggtgatgaaacagctcaagaggcgcagatacaccggatggggtagactctccaggaagctgattaatggcatccgcgacaaacagtccggcaagaccatcctcgacttcctcaagagtgacggattcgccaaccgcaacttcatgcagctcatacacgacgactccctcaccttcaaggaggacatccaaaaagcccaagtctccggacagggagactcattgcacgaacacatcgccaacttggctggatctcctgctattaaaaagggcatcctccaaaccgtcaaggtggtcgacgaactcgtcaaggtcatgggtagacacaagcccgaaaatatcgtcatcgagatggcaagggagaaccagacaacccagaagggccaaaaaaactccagggagcgcatgaaacgcatcgaggagggaataaaggagctcgggtcccagatcctcaaggagcaccccgtcgaaaatactcaactccagaatgaaaagctctacctctactacctccaaaacggcagggatatgtacgtcgaccaagagctcgacattaatcgcctctccgactacgacgtcgatcacatcgtcccccagagtttcctcaaggacgactccatcgacaacaaggtcctcaccagatccgataaaaatcgcggaaagtccgacaacgtcccctctgaggaagtggttaagaagatgaaaaactactggagacagctcctcaacgcaaagctgatcacccagcgcaagttcgacaacctcacaaaggctgagagagggggactctctgagttggacaaggccggcttcatcaagagacaactcgtggaaacccgccagatcaccaagcatgtcgcacagattctcgactcccgcatgaatactaaatacgatgaaaatgacaagctcatcagggaggtcaaggtcatcaccctgaagtccaagctcgtctccgacttccgcaaggacttccagttctacaaggtccgcgagatcaacaactaccaccacgcccacgacgcatacctcaacgctgtggttggaacagcactcatcaagaagtaccccaagctcgagtccgagttcgtctacggcgactacaaggtctacgacgtcaggaagatgatcgccaagtccgagcaagagatcggaaaggccaccgcaaaatatttcttctactccaacataatgaacttcttcaaaaccgagatcaccctggctaacggagaaataaggaagaggcccctgatagaaaccaacggcgagacaggcgagattgtctgggacaaaggcagggacttcgcaaccgtcagaaaggtgctcagtatgcctcaggtcaacatagtcaaaaagaccgaagtccagactggaggattctccaaggagtccatcctccccaaaaggaactccgacaaactgatcgccaggaaaaaggactgggaccccaaaaaatatggcggcttcgactcccctactgttgcttacagtgtgctcgtcgtcgcaaaagtcgagaaggggaaatccaagaagctcaagtcagtgaaggagctcctcggcatcaccatcatggagaggtcctccttcgagaagaaccccatcgacttcctcgaggccaagggatataaggaggtcaagaaggacctcatcattaaactccccaagtactccctcttcgagctcgaaaacggacgcaagaggatgctcgcttcagctggtgaactccagaagggcaacgaactcgctttgccctctaaatacgtcaacttcctctacctcgcctcccactatgaaaagctcaagggctccccagaggacaacgagcagaagcaactcttcgtcgagcagcacaagcattacctcgacgagatcatcgagcagatctccgagttctccaagagagtcatcctcgctgacgcaaacctcgacaaggtcctcagtgcatataacaagcaccgcgacaaaccaataagggagcaggccgaaaatattatacacctgttcaccctcaccaacttgggagcaccagccgccttcaagtatttcgacaccaccatcgacagaaagcgctacacctccacaaaggaggtcctggacgccacacttatccaccagtccatcaccggcctctatgaaacacgcatcgacctctctcaattgggaggggacaagagaccaagagacagacacgatggagagcttggaggtagaaagagagcaaggtagttcgaactggccaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttggcgcgccgttaacttaacggcaaacgctaattagtcactaggcccaggaaacactaactaagccctagcttatcctagcgcaacctagttaggtcttggtaacccgaaatctagtctaggtgtgttttgcgatccgatatcgatgcggccgcctggaattcgcccttcccaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataaccatgccacacaacacaatggcggccaccgcttccagaaccacccgattctcttcttcctcttcacaccccaccttccccaaacgcattactagatccaccctccctctctctcatcaaaccctcaccaaacccaaccacgctctcaaaatcaaatgttccatctccaaaccccccacggcggcgcccttcaccaaggaagcgccgaccacggagcccttcgtgtcacggttcgcctccggcgaacctcgcaagggcgcggacatccttgtggaggcgctggagaggcagggcgtgacgacggtgttcgcgtaccccggcggtgcgtcgatggagatccaccaggcgctcacgcgctccgccgccatccgcaacgtgctcccgcgccacgagcagggcggcgtcttcgccgccgaaggctacgcgcgttcctccggcctccccggcgtctgcattgccacctccggccccggcgccaccaacctcgtgagcggcctcgccgacgctttaatggacagcgtcccagtcgtcgccatcaccggccaggtcgcccgccggatgatcggcaccgacgccttccaagaaaccccgatcgtggaggtgagcagatccatcacgaagcacaactacctcatcctcgacgtcgacgacatcccccgcgtcgtcgccgaggctttcttcgtcgccacctccggccgccccggtccggtcctcatcgacattcccaaagacgttcagcagcaactcgccgtgcctaattgggacgagcccgttaacctccccggttacctcgccaggctgcccaggccccccgccgaggcccaattggaacacattgtcagactcatcatggaggcccaaaagcccgttctctacgtcggcggtggcagtttgaattccagtgctgaattgaggcgctttgttgaactcactggtattcccgttgctagcactttaatgggtcttggaacttttcctattggtgatgaatattcccttcagatgctgggtatgcatggtactgtttatgctaactatgctgttgacaatagtgatttgttgcttgcctttggggtaaggtttgatgaccgtgttactgggaagcttgaggcttttgctagtagggctaagattgttcacattgatattgattctgccgagattgggaagaacaagcaggcgcacgtgtcggtttgcgcggatttgaagttggccttgaagggaattaatatgattttggaggagaaaggagtggagggtaagtttgatcttggaggttggagagaagagattaatgtgcagaaacacaagtttccattgggttacaagacattccaggacgcgatttctccgcagcatgctatcgaggttcttgatgagttgactaatggagatgctattgttagtactggggttgggcagcatcaaatgtgggctgcgcagttttacaagtacaagagaccgaggcagtggttgacctcagggggtcttggagccatgggttttggattgcctgcggctattggtgctgctgttgctaaccctggggctgttgtggttgacattgatggggatggtagtttcatcatgaatgttcaggagttggccactataagagtggagaatctcccagttaagatattgttgttgaacaatcagcatttgggtatggtggttcagttggaggataggttctacaagtccaatagagctcacacctatcttggagatccgtctagcgagagcgagatattcccaaacatgctcaagtttgctgatgcttgtgggataccggcagcgcgagtgacgaagaaggaagagcttagagcggcaattcagagaatgttggacacccctggcccctaccttcttgatgtcattgtgccccatcaggagcatgtgttgccgatgattcccagtaatggatccttcaaggatgtgataactgagggtgatggtagaacgaggtactgattgcctagaccaaatgttccttgatgcttgttttgtacaatatatataagataatgctgtcctagttgcaggatttggcctgtggtgagcatcatagtctgtagtagttttggtagcaagacattttattttccttttatttaacttactacatgcagtagcatctatctatctctgtagtctgatatctcctgttgtctgtattgtgccgttggattttttgctgtagtgagactgaaaatgatgtgctagtaataatatttctgttagaaatctaagtagagaatctgttgaagaagtcaaaagctaatggaatcaggttacatattcaatgtttttctttttttagcggttggtagacgtgtagattcaacttctcttggagctcacctaggcaatcagtaaaatgcatattccttttttaacttgccatttatttacttttagtggaaattgtgaccaatttgttcatgtagaacggatttggaccattgcgtccacaaaacgtctcttttgctcgatcttcacaaagcgataccgaaatccagagatagttttcaaaagtcagaaatggcaaagttataaatagtaaaacagaatagatgctgtaatcgacttcaataacaagtggcatcacgtttctagttctagacccatcagctgaggtacaaattaattaataagtgactagggtcacgtgaccctagtcacttatgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttctagctagctaagtttaaacggccggccaaacgtgcaagcgctactagacaattcagtacattaaaaacgtccgcaatgtgttattaagttgtctaagcgtcaatttatttacaattgaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggcgcgcgcggtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaacgcgcgcgggcgcgccttttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatggcgcgccggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtaggaacagtgaattggagttcgtcttgttataattagcttcttgggggatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatacttcgctcgtgaaaagcagcgctcagggggctagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtacgttggaatcgcttctacaaaa

SEQ ID NO: 61 - DNA, 33156 bp, Artificial
  Vector 16
ctcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaacgaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacctagctaggttaccccgggcaatcaaattatatatgtaaagcaattacagtttatcaaactttatttatggaaataatttattatcacatttattttggtttataaattttaaattaaaatatcacctaaataaaaataatttttaacatgacttattgtcctaaataaattatttccgtaaattaaataaaatgaagtttttttctttcaaagaatctaaatggtcataatgagaattctctaaaaaaatacataatgagaataattatggaatttatttattaataaaaattaatagcattttgatagacaattaataaaattttaaaaataaccatatagaaataataatttttttactatcggttccaattaaaataatgataaaaaataaaatagattattaattgatattgatatgaaatttaaataaagaatataatcatatattttattgatatatgatatgatatagattaattgatattgattttgatatggaatttaaaaataatataataattgtttttatttattaatacgtgtaatcaaataattctcactttttgaatcaatcagtgtacttaaagataatatcagttgaatattttttatccttttacgtgtgctgtgagacattatcatcaattgtgttgtatatgatatatagatatagatatataaatatatagattgagtgatataatatatttaaaatataaattatatatatgttttaatatatttttgcatatatatatatatttgtaaaaactagaagtattttttcatgagataattattatcgagttgaataagtctattatttgtgagagccaaccatatttatatatgtgattaaattttatctttgtgaaattaaaaataataaaaaataccttaaaatcataataatagaaaaacttatatttataatttaccattatacttaaaaaaaattaaataaatattataaatataaatactatcgagtaatggccgcgctagggtttttgagaaaaaatcttcccacgcactcaactgcactgtacggcgtcgttttcacagccgcataatagaagccgcgttccccaacccttcctcacaacattctcggaccctccagcaccgtcacccaaacaaatatccacgcggtagtaggcgcgtgaaacaaactctaatccgaactacgagacgtgagaagcacgcgctttagcgagcgtttcaattgtcgctacgaaagcagagaaggatacaaacggaactagggtaaattagtaagggtaatttcgtaaacagaagaaaagagttgtagctataaataaaccctctaaccctcgtcgcattacttctcttcacacctttgttcactcttcttctcttgcggctagggttttagcgcagcttcttctaggttcgttatctaccaccgttctatggattttattccttctattcgtgtttattctattggtttatgttgcttgcaatatgttttttctgaatctgtcgtcgttgtcttcaattttatccatgtttcagagatcaattttgtttgtgtagtatgtgcttattcttcttcttttcgttcgagttgttaataacggtgctatggtgttttcaaaagtgttttttttattacttttgatttaaagtttttttggtaaggcttttatttgcttgttatattcaaatctttggatccagatcttatataagtttttggttcaagaaagtttttggttactgatgaatagatctattaactgttactttaatcgattcaagctaaagttttttggttactgatgaatagatctattatctgttacttttaatcggttcaagctcaagttttttggttactgatgaatagatctatatacgtcacagtgtgctaaacatgcccttgttttatctcgatcttatgtatgggagtgccataaattttgttatgtctatttttttatctgttggaatcatactgagtttgatgcgttacgattgagcatacctatttttgggcttgttgtatggtgggtatttagatcttaatctttttatgcttatgaaaggttttgtaatgacaaaggtcttaatgttgttaaacttttatttttactttatatggtgtgttgatgtgttatggttttgacaactttttttttttctggatttttgcagatttaaggaagggtgctaagcacgacatccatggagcctcctcagcaccaacatcaccaccatcaggccgatcaagagtccgggaacaacaacaacaacaagtccggttccggagggtacacttgcagacagacctccaccagatggacacctaccactgagcagatcaagatcctgaaggagttgtactacaacaatgccatccgctcccctactgctgatcagattcagaagatcaccgctcgcctgcgtcaattcggtaagatcgagggtaagaacgtcttctactggttccagaaccacaaggctcgtgagaggcagaagaagcgtttcaacgggactaacatgaccactccttcctcatcacccaattctgttatgatggccgccaacgaccactaccatcctttgcttcatcaccaccacggagttcctatgcaaagacccgcaaactccgtcaacgtgaagttgaaccaggaccatcacctctaccaccacaacaagccctacccctctttcaacaacgggaatctcaaccatgcctcctctggaaccgaatgtggagttgtcaacgcctccaacggctacatgtcttcccacgtgtacggctctatggagcaagattgctccatgaactacaacaacgttggaggcggatgggcaaacatggatcaccactactcctccgctccctacaacttcttcgatagggctaaacctctcttcggcttggagggacaccaagaagaagaggaatgcggaggtgatgcttacttggaacacagaaggactctccctctctttccaatgcacggtgaggaccacatcaacggaggatctggcgctatctggaagtatggacagtccgaggtcagaccatgcgcttccctggaattgagactgaactagattgggacctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagaggtaccggcggccgggggctcggcgttaggcttttagtccgctaggtggctagaccgaggttaggacgctagttcactaggggcctagtggtgttttaaggatggcgaccccagtgatggcaactaagtggatcaacagcaacttttgctccgatttgcgatataatttgtcaaaacatgcctctaaaatcactctaacatcaaatttcttgaataacaattttatacactcccctcctccaacttgttatgtgcccttctgacccttcttgttttgtttgctagttaaccatgtaggaaaaagtatcactccactcaatagtattttcacttcatctggccataaataattttggcctaattcagcatcacgtatcaggagtcaataagcttgtctgtccgtctgtatttatcatctctcttcgtgctactatcacctccccttttcttatggatttttcctgttaaaaaacaaaaaggaacaggtaacccacttgaattaggacaccaatgtaggtgccaccacccgtttccttctgttgagtgtgcacgcttattggttcaacctcagaattaaattcttcataatcccctgttgagagaaaattataatagacaaatcaaattgtgtggacttgccatttcccaaaacattttcattttgtgcgcgtgtgggtggtggggtgcgttttattagaatgaagactgtaaaaaagaggagtgtaggatgataagaagtagtaaatgtcagttgtcaaaagatgaaaagcaacggaggaagggaccaaaccttgacctatggaaaactgagtgctatggtaattattgtcacaggatttaggatgattaataatagttcggaccacaaataaacagctttaagaagttcaactttcccccacggatagcaaatttggttggaccatctttgatgaaagtccccaatctcataattgccaaccttttttatacgaaactagtattttcataattatcaagaatcttcaactcatcagtgatcgctcatttctgattaagaaaaaaaaagggtgagtaaatgaatccattttgtctgttctccatggcccgggtaccctgggatccgatatcgatgggccctggccgaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataaccatgccacacaacacaatggcggccaccgcttccagaaccacccgattctcttcttcctcttcacaccccaccttccccaaacgcattactagatccaccctccctctctctcatcaaaccctcaccaaacccaaccacgctctcaaaatcaaatgttccatctccaaaccccccacggcggcgcccttcaccaaggaagcgccgaccacggagcccttcgtgtcacggttcgcctccggcgaacctcgcaagggcgcggacatccttgtggaggcgctggagaggcagggcgtgacgacggtgttcgcgtaccccggcggtgcgtcgatggagatccaccaggcgctcacgcgctccgccgccatccgcaacgtgctcccgcgccacgagcagggcggcgtcttcgccgccgaaggctacgcgcgttcctccggcctccccggcgtctgcattgccacctccggccccggcgccaccaacctcgtgagcggcctcgccgacgctttaatggacagcgtcccagtcgtcgccatcaccggccaggtcgcccgccggatgatcggcaccgacgccttccaagaaaccccgatcgtggaggtgagcagatccatcacgaagcacaactacctcatcctcgacgtcgacgacatcccccgcgtcgtcgccgaggctttcttcgtcgccacctccggccgccccggtccggtcctcatcgacattcccaaagacgttcagcagcaactcgccgtgcctaattgggacgagcccgttaacctccccggttacctcgccaggctgcccaggccccccgccgaggcccaattggaacacattgtcagactcatcatggaggcccaaaagcccgttctctacgtcggcggtggcagtttgaattccagtgctgaattgaggcgctttgttgaactcactggtattcccgttgctagcactttaatgggtcttggaacttttcctattggtgatgaatattcccttcagatgctgggtatgcatggtactgtttatgctaactatgctgttgacaatagtgatttgttgcttgcctttggggtaaggtttgatgaccgtgttactgggaagcttgaggcttttgctagtagggctaagattgttcacattgatattgattctgccgagattgggaagaacaagcaggcgcacgtgtcggtttgcgcggatttgaagttggccttgaagggaattaatatgattttggaggagaaaggagtggagggtaagtttgatcttggaggttggagagaagagattaatgtgcagaaacacaagtttccattgggttacaagacattccaggacgcgatttctccgcagcatgctatcgaggttcttgatgagttgactaatggagatgctattgttagtactggggttgggcagcatcaaatgtgggctgcgcagttttacaagtacaagagaccgaggcagtggttgacctcagggggtcttggagccatgggttttggattgcctgcggctattggtgctgctgttgctaaccctggggctgttgtggttgacattgatggggatggtagtttcatcatgaatgttcaggagttggccactataagagtggagaatctcccagttaagatattgttgttgaacaatcagcatttgggtatggtggttcagttggaggataggttctacaagtccaatagagctcacacctatcttggagatccgtctagcgagagcgagatattcccaaacatgctcaagtttgctgatgcttgtgggataccggcagcgcgagtgacgaagaaggaagagcttagagcggcaattcagagaatgttggacacccctggcccctaccttcttgatgtcattgtgccccatcaggagcatgtgttgccgatgattcccagtaatggatccttcaaggatgtgataactgagggtgatggtagaacgaggtactgattgcctagaccaaatgttccttgatgcttgttttgtacaatatatataagataatgctgtcctagttgcaggatttggcctgtggtgagcatcatagtctgtagtagttttggtagcaagacattttattttccttttatttaacttactacatgcagtagcatctatctatctctgtagtctgatatctcctgttgtctgtattgtgccgttggattttttgctgtagtgagactgaaaatgatgtgctagtaataatatttctgttagaaatctaagtagagaatctgttgaagaagtcaaaagctaatggaatcaggttacatattcaatgtttttctttttttagcggttggtagacgtgtagattcaacttctcttggagctcacctaggcaatcagtaaaatgcatattccttttttaacttgccatttatttacttttagtggaaattgtgaccaatttgttcatgtagaacggatttggaccattgcgtccacaaaacgtctcttttgctcgatcttcacaaagcgataccgaaatccagagatagttttcaaaagtcagaaatggcaaagttataaatagtaaaacagaatagatgctgtaatcgacttcaataacaagtggcatcacgtttctagttctagacccatcagctggggaattctagtggccggcccagctgatatcatgtcgtgcttagcacgtgatgcatcatagatgcggtaaattattactttctgtgactgggacaatgtgctcctccagtggccacgtatcggtaaaccttgtgccagaacactaatatttatataatcaacaataaagaatggtaagcattagacaaagacaaaaacaatttttaataatttacctgtactaattagaaggggtttgatttaattttattaaacttaacatgtgcaatatgtccctttgtttagaggaaaacaattacggtatttccttactaacgtaaactctgaatataatcatacatctgtattctgaaaaagaaaaaagaactagagataaaagcgtagaaacaacagtatgtggtcatagtcatacacgtaaagggatgaaaattgaaaatagaacctgcaggaaataagtttgcatttaatttggatatatatcttgaagtgtaaggttaacctctcagctattaaatagtactactactaacactcaaatagtacttctactagcactcacggtaacaatctcttagtagggatgggaataggccagatcggcctacaggggtctacgacttgaggtgctaagcacgacatccatggcctagatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgacgaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagttttgtgatctgatgataagtggttggttcgtgtctcatgcacttgggaggtgatctatttcacctggtgtagtttgtgtttccgtcagttggaaaaacttatccctatcgatttcgttttcattttctgcttttcttttatgtaccttcgtttgggcttgtaacgggcctttgtatttcaactctcaataataatccaagtgcatgttaaacaatttgtcatctgtttcggctttgatatactactggtgaagatgggccgtactactgcatcacaacgaaaaataataataagatgaaaaacttgaagtggaaaaaaaaaaaaacttgaatgttcactactactcattgaccataatgtttaacatacatagctcaatagtatttttgtgaatatggcaacacaaacagtccaaaacaattgtctcttactataccaaaccaagggcgccgcttgtttgccactctttgtgtgcaatagtgtgattaccacatctccacattcaatatattccctgaattatctgacgattttgatggctcactgttttcccaagtcttgaattgtcttctgtgcgccagtcaaatgcatatgtgttgagtttatcttttaaatatcaagcttttgtttttaacttttgtttgtaaccaaaaactcacagtaggagtttgatcacataattttatgtttgcctttgcaatttctagtgagtctttgattaaaagcttgaaaagaaaatgcagccaagcttaccaagtaagttatgtgtattaaccagaggaagagagaatcttgcaaaatttcaacaaacacaaaaagaagtattactacgattggtggagaaagaaaacgattccaaatcttgaactgttgttgtaaaagcatagcagaaagtgggagacaaccgaaatagaaatgactataacttaatttaatgttatcattataatttcttctagcaaatatttagaaagtaaatatcacatcaacctttaatgtaattaagctttctctttttgattcatgtgagatgaaaagaaaaaaaagaagagaaaagtgtagaaaacacatcatttctaagctgaaggtacccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttggtgctaagcacgacatccagttttagagctagaaatagcaagttaaaataaggctagtccgttatcaacttgaaaaagtggcaccgagtcggtgcttttttttcggaccgggttaccagtctaaaaacggcccctaactaacgcttagttgcccgctagattagtcccccgttagtgcctagttagacacacgacgaactaggggctactagtagcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcacctaaaaagaagaggaaagttatggacaaaaagtactccatagggctcgatatcggcacaaacagtgtggggtgggcagtcatcactgacgactacaaggtcccctccaagaagttcaaggtcctcggcaatacagaccgccactccatcaagaagaacctcatcggagcactgttgttcgactccggagaaactgccgaagcaaccagactcaagaggaccgccagaagaaggtacacaaggcgcaagaacaggatctgctacctccaggagatcttcagtaacgagatggcaaaggtcgacgactctttcttccacaggctcgaggaatccttcctcgtcgaggaggacaagaagcatgagagacaccccatcttcggaaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtcgcctaccacgagaagtacccaaccatctaccacctgaggaagaagctcgtcgacagtaccgacaaggctgacctcaggctcatctacctcgcactcgcccacatgattaagttcaggggccacttcctcatagagggagacctcaacccagacaactccgacgtcgacaaactcttcatccaactcgtgcagacctacaatcaactctttgaagagaacccaatcaacgcctccggagtggatgctaaggctatattgtccgccaggctctccaaatcaagacgcctcgaaaacctcatcgcccagctcccaggggagaagaaaaatagcctcttcgggaacctcatagccctgtcccttggactcacccctaacttcaaatcaaatttcgacctcgcagaggacgctaagcttcaactctccaaggacacctacgacgacgacctcgataacctcctcgcccaaatcggtgatcaatacgctgacctcttcctcgctgctaagaacctctccgacgccatactcctctccgacattctgagggtcaacaccgagatcacaaaggctcccttgtccgcctccatgattaaacgctacgacgaacaccaccaggacctcaccctcttgaaggcactggttagacagcagctccccgagaagtacaaggaaatcttcttcgaccaatcaaaaaacggctacgccggatacatcgacggaggagcatcccaggaagagttctacaagttcatcaaaccaattctcgaaaagatggacggaacagaggagctcttggtcaagctcaacagggaggacctcctcagaaagcagagaaccttcgacaacggcagtatcccccaccagatccaccttggagagttgcacgcaatcctcaggaggcaagaggacttctaccccttcctcaaggacaacagggagaagatcgagaagatccttacattccgcatcccctactacgtcggacctttggcaagaggaaactcccgcttcgcatggatgactcgcaagagtgaggaaaccatcaccccttggaacttcgaggaggtcgtcgataagggagcttcagcccagtccttcatcgagcgcatgaccaacttcgataaaaatctccccaatgaaaaagtcctccccaagcacagtctgctctacgagtacttcacagtctacaacgagctcaccaaggtcaagtacgtcaccgaaggcatgagaaaacccgccttcctcagtggcgagcagaagaaggcaatcgtggacttgctgttcaagaccaaccgcaaggtcacagtcaagcaattaaaagaggactacttcaagaaaatagagtgcttcgacagtgtcgagatctctggggtcgaggacaggttcaacgcatccttggggacctatcacgacctcctcaagatcattaaagacaaggacttcctcgacaacgaggagaacgaggacatactggaggacatcgtcctcaccctcactctctttgaggacagggagatgatagaggagcgcctcaaaacctacgcccacctcttcgacgacaaggtgatgaaacagctcaagaggcgcagatacaccggatggggtagactctccaggaagctgattaatggcatccgcgacaaacagtccggcaagaccatcctcgacttcctcaagagtgacggattcgccaaccgcaacttcatgcagctcatacacgacgactccctcaccttcaaggaggacatccaaaaagcccaagtctccggacagggagactcattgcacgaacacatcgccaacttggctggatctcctgctattaaaaagggcatcctccaaaccgtcaaggtggtcgacgaactcgtcaaggtcatgggtagacacaagcccgaaaatatcgtcatcgagatggcaagggagaaccagacaacccagaagggccaaaaaaactccagggagcgcatgaaacgcatcgaggagggaataaaggagctcgggtcccagatcctcaaggagcaccccgtcgaaaatactcaactccagaatgaaaagctctacctctactacctccaaaacggcagggatatgtacgtcgaccaagagctcgacattaatcgcctctccgactacgacgtcgatcacatcgtcccccagagtttcctcaaggacgactccatcgacaacaaggtcctcaccagatccgataaaaatcgcggaaagtccgacaacgtcccctctgaggaagtggttaagaagatgaaaaactactggagacagctcctcaacgcaaagctgatcacccagcgcaagttcgacaacctcacaaaggctgagagagggggactctctgagttggacaaggccggcttcatcaagagacaactcgtggaaacccgccagatcaccaagcatgtcgcacagattctcgactcccgcatgaatactaaatacgatgaaaatgacaagctcatcagggaggtcaaggtcatcaccctgaagtccaagctcgtctccgacttccgcaaggacttccagttctacaaggtccgcgagatcaacaactaccaccacgcccacgacgcatacctcaacgctgtggttggaacagcactcatcaagaagtaccccaagctcgagtccgagttcgtctacggcgactacaaggtctacgacgtcaggaagatgatcgccaagtccgagcaagagatcggaaaggccaccgcaaaatatttcttctactccaacataatgaacttcttcaaaaccgagatcaccctggctaacggagaaataaggaagaggcccctgatagaaaccaacggcgagacaggcgagattgtctgggacaaaggcagggacttcgcaaccgtcagaaaggtgctcagtatgcctcaggtcaacatagtcaaaaagaccgaagtccagactggaggattctccaaggagtccatcctccccaaaaggaactccgacaaactgatcgccaggaaaaaggactgggaccccaaaaaatatggcggcttcgactcccctactgttgcttacagtgtgctcgtcgtcgcaaaagtcgagaaggggaaatccaagaagctcaagtcagtgaaggagctcctcggcatcaccatcatggagaggtcctccttcgagaagaaccccatcgacttcctcgaggccaagggatataaggaggtcaagaaggacctcatcattaaactccccaagtactccctcttcgagctcgaaaacggacgcaagaggatgctcgcttcagctggtgaactccagaagggcaacgaactcgctttgccctctaaatacgtcaacttcctctacctcgcctcccactatgaaaagctcaagggctccccagaggacaacgagcagaagcaactcttcgtcgagcagcacaagcattacctcgacgagatcatcgagcagatctccgagttctccaagagagtcatcctcgctgacgcaaacctcgacaaggtcctcagtgcatataacaagcaccgcgacaaaccaataagggagcaggccgaaaatattatacacctgttcaccctcaccaacttgggagcaccagccgccttcaagtatttcgacaccaccatcgacagaaagcgctacacctccacaaaggaggtcctggacgccacacttatccaccagtccatcaccggcctctatgaaacacgcatcgacctctctcaattgggaggggacaagagaccaagagacagacacgatggagagcttggaggtagaaagagagcaaggtagttcgaactggccaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttggcgcgccgttaacttaacggcaaacgctaattagtcactaggcccaggaaacactaactaagccctagcttatcctagcgcaacctagttaggtcttggtaacccgagatatcgatgcggccgccgctccgggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattctagtggccggcccagctgatatctagacccagctttcttgtacaaagtggcccggggcggccgaagctggccttctaggcccggaccgggtgaccaagcttggcgcgcccagggcccatcgatatcggtacctacgcgttcgaatatccatggatccgaattccgcggccgcttggtaacccggtccgggccattctggccgatccgttaacgcccgggcaactttattatacaaagttgatggtacggatccgtcgacggcgcgccgcggacctgaattccagcacactggcggccgttactagtaacggccgccagtgtgctggaattcgcccttcccaagctttgctctagatcaaactcacatccaaacataacatggatatcttccttaccaatcatactaattattttgggttaaatattaatcattatttttaagatattaattaataagtgactagggtcacgtgaccctagtcacttatgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttctagctagctaagtttaaacggccggccaaacgtgcaagcgctactagacaattcagtacattaaaaacgtccgcaatgtgttattaagttgtctaagcgtcaatttatttacaattgaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggcgcgcgcggtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaacgcgcgcgggcgcgccttttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatggcgcgccggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtaggaacagtgaattggagttcgtcttgttataattagcttcttgggggatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatacttcgctcgtgaaaagcagcgctcagggggctagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtacgttggaatcgcttctacaaaa

SEQ ID NO: 62 - DNA, 32777 bp, Artificial
  Vector 17
ctcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaacgaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacctagctaggttaccccgggcaatcaaattatatatgtaaagcaattacagtttatcaaactttatttatggaaataatttattatcacatttattttggtttataaattttaaattaaaatatcacctaaataaaaataatttttaacatgacttattgtcctaaataaattatttccgtaaattaaataaaatgaagtttttttctttcaaagaatctaaatggtcataatgagaattctctaaaaaaatacataatgagaataattatggaatttatttattaataaaaattaatagcattttgatagacaattaataaaattttaaaaataaccatatagaaataataatttttttactatcggttccaattaaaataatgataaaaaataaaatagattattaattgatattgatatgaaatttaaataaagaatataatcatatattttattgatatatgatatgatatagattaattgatattgattttgatatggaatttaaaaataatataataattgtttttatttattaatacgtgtaatcaaataattctcactttttgaatcaatcagtgtacttaaagataatatcagttgaatattttttatccttttacgtgtgctgtgagacattatcatcaattgtgttgtatatgatatatagatatagatatataaatatatagattgagtgatataatatatttaaaatataaattatatatatgttttaatatatttttgcatatatatatatatttgtaaaaactagaagtattttttcatgagataattattatcgagttgaataagtctattatttgtgagagccaaccatatttatatatgtgattaaattttatctttgtgaaattaaaaataataaaaaataccttaaaatcataataatagaaaaacttatatttataatttaccattatacttaaaaaaaattaaataaatattataaatataaatactatcgagtaatggccgcgctagggtttttgagaaaaaatcttcccacgcactcaactgcactgtacggcgtcgttttcacagccgcataatagaagccgcgttccccaacccttcctcacaacattctcggaccctccagcaccgtcacccaaacaaatatccacgcggtagtaggcgcgtgaaacaaactctaatccgaactacgagacgtgagaagcacgcgctttagcgagcgtttcaattgtcgctacgaaagcagagaaggatacaaacggaactagggtaaattagtaagggtaatttcgtaaacagaagaaaagagttgtagctataaataaaccctctaaccctcgtcgcattacttctcttcacacctttgttcactcttcttctcttgcggctagggttttagcgcagcttcttctaggttcgttatctaccaccgttctatggattttattccttctattcgtgtttattctattggtttatgttgcttgcaatatgttttttctgaatctgtcgtcgttgtcttcaattttatccatgtttcagagatcaattttgtttgtgtagtatgtgcttattcttcttcttttcgttcgagttgttaataacggtgctatggtgttttcaaaagtgttttttttattacttttgatttaaagtttttttggtaaggcttttatttgcttgttatattcaaatctttggatccagatcttatataagtttttggttcaagaaagtttttggttactgatgaatagatctattaactgttactttaatcgattcaagctaaagttttttggttactgatgaatagatctattatctgttacttttaatcggttcaagctcaagttttttggttactgatgaatagatctatatacgtcacagtgtgctaaacatgcccttgttttatctcgatcttatgtatgggagtgccataaattttgttatgtctatttttttatctgttggaatcatactgagtttgatgcgttacgattgagcatacctatttttgggcttgttgtatggtgggtatttagatcttaatctttttatgcttatgaaaggttttgtaatgacaaaggtcttaatgttgttaaacttttatttttactttatatggtgtgttgatgtgttatggttttgacaactttttttttttctggatttttgcagatttaaggaagggtgctaagcacgacatccatggagcctcctcagcaccaacatcaccaccatcaggccgatcaagagtccgggaacaacaacaacaacaagtccggttccggagggtacacttgcagacagacctccaccagatggacacctaccactgagcagatcaagatcctgaaggagttgtactacaacaatgccatccgctcccctactgctgatcagattcagaagatcaccgctcgcctgcgtcaattcggtaagatcgagggtaagaacgtcttctactggttccagaaccacaaggctcgtgagaggcagaagaagcgtttcaacgggactaacatgaccactccttcctcatcacccaattctgttatgatggccgccaacgaccactaccatcctttgcttcatcaccaccacggagttcctatgcaaagacccgcaaactccgtcaacgtgaagttgaaccaggaccatcacctctaccaccacaacaagccctacccctctttcaacaacgggaatctcaaccatgcctcctctggaaccgaatgtggagttgtcaacgcctccaacggctacatgtcttcccacgtgtacggctctatggagcaagattgctccatgaactacaacaacgttggaggcggatgggcaaacatggatcaccactactcctccgctccctacaacttcttcgatagggctaaacctctcttcggcttggagggacaccaagaagaagaggaatgcggaggtgatgcttacttggaacacagaaggactctccctctctttccaatgcacggtgaggaccacatcaacggaggatctggcgctatctggaagtatggacagtccgaggtcagaccatgcgcttccctggaattgagactgaactagattgggacctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagaggtaccggcggccgggggctcggcgttaggcttttagtccgctaggtggctagaccgaggttaggacgctagttcactaggggcctagtggtgttttaaggatggcgaccccagtgatggcaactaagtggatcaacagcaacttttgctccgatttgcgatataatttgtcaaaacatgcctctaaaatcactctaacatcaaatttcttgaataacaattttatacactcccctcctccaacttgttatgtgcccttctgacccttcttgttttgtttgctagttaaccatgtaggaaaaagtatcactccactcaatagtattttcacttcatctggccataaataattttggcctaattcagcatcacgtatcaggagtcaataagcttgtctgtccgtctgtatttatcatctctcttcgtgctactatcacctccccttttcttatggatttttcctgttaaaaaacaaaaaggaacaggtaacccacttgaattaggacaccaatgtaggtgccaccacccgtttccttctgttgagtgtgcacgcttattggttcaacctcagaattaaattcttcataatcccctgttgagagaaaattataatagacaaatcaaattgtgtggacttgccatttcccaaaacattttcattttgtgcgcgtgtgggtggtggggtgcgttttattagaatgaagactgtaaaaaagaggagtgtaggatgataagaagtagtaaatgtcagttgtcaaaagatgaaaagcaacggaggaagggaccaaaccttgacctatggaaaactgagtgctatggtaattattgtcacaggatttaggatgattaataatagttcggaccacaaataaacagctttaagaagttcaactttcccccacggatagcaaatttggttggaccatctttgatgaaagtccccaatctcataattgccaaccttttttatacgaaactagtattttcataattatcaagaatcttcaactcatcagtgatcgctcatttctgattaagaaaaaaaaagggtgagtaaatgaatccattttgtctgttctccatggcccgggtaccctgggatccgatatcgatgggccctggccggtgaccaagcttggcgcgcccagggccgccagtgtgatggatatctcgacccgggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattccgcggccgcttggtaaccgatatcatgtcgtgcttagcacgtgatgcatcatagatgcggtaaattattactttctgtgactgggacaatgtgctcctccagtggccacgtatcggtaaaccttgtgccagaacactaatatttatataatcaacaataaagaatggtaagcattagacaaagacaaaaacaatttttaataatttacctgtactaattagaaggggtttgatttaattttattaaacttaacatgtgcaatatgtccctttgtttagaggaaaacaattacggtatttccttactaacgtaaactctgaatataatcatacatctgtattctgaaaaagaaaaaagaactagagataaaagcgtagaaacaacagtatgtggtcatagtcatacacgtaaagggatgaaaattgaaaatagaacctgcaggaaataagtttgcatttaatttggatatatatcttgaagtgtaaggttaacctctcagctattaaatagtactactactaacactcaaatagtacttctactagcactcacggtaacaatctcttagtagggatgggaataggccagatcggcctacaggggtctacgacttgaggtgctaagcacgacatccatggcctagatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgacgaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagttttgtgatctgatgataagtggttggttcgtgtctcatgcacttgggaggtgatctatttcacctggtgtagtttgtgtttccgtcagttggaaaaacttatccctatcgatttcgttttcattttctgcttttcttttatgtaccttcgtttgggcttgtaacgggcctttgtatttcaactctcaataataatccaagtgcatgttaaacaatttgtcatctgtttcggctttgatatactactggtgaagatgggccgtactactgcatcacaacgaaaaataataataagatgaaaaacttgaagtggaaaaaaaaaaaaacttgaatgttcactactactcattgaccataatgtttaacatacatagctcaatagtatttttgtgaatatggcaacacaaacagtccaaaacaattgtctcttactataccaaaccaagggcgccgcttgtttgccactctttgtgtgcaatagtgtgattaccacatctccacattcaatatattccctgaattatctgacgattttgatggctcactgttttcccaagtcttgaattgtcttctgtgcgccagtcaaatgcatatgtgttgagtttatcttttaaatatcaagcttttgtttttaacttttgtttgtaaccaaaaactcacagtaggagtttgatcacataattttatgtttgcctttgcaatttctagtgagtctttgattaaaagcttgaaaagaaaatgcagccaagcttaccaagtaagttatgtgtattaaccagaggaagagagaatcttgcaaaatttcaacaaacacaaaaagaagtattactacgattggtggagaaagaaaacgattccaaatcttgaactgttgttgtaaaagcatagcagaaagtgggagacaaccgaaatagaaatgactataacttaatttaatgttatcattataatttcttctagcaaatatttagaaagtaaatatcacatcaacctttaatgtaattaagctttctctttttgattcatgtgagatgaaaagaaaaaaaagaagagaaaagtgtagaaaacacatcatttctaagctgaaggtacccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttggtgctaagcacgacatccagttttagagctagaaatagcaagttaaaataaggctagtccgttatcaacttgaaaaagtggcaccgagtcggtgcttttttttcggaccgggttaccagtctaaaaacggcccctaactaacgcttagttgcccgctagattagtcccccgttagtgcctagttagacacacgacgaactaggggctactagtagcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcacctaaaaagaagaggaaagttatggacaaaaagtactccatagggctcgatatcggcacaaacagtgtggggtgggcagtcatcactgacgactacaaggtcccctccaagaagttcaaggtcctcggcaatacagaccgccactccatcaagaagaacctcatcggagcactgttgttcgactccggagaaactgccgaagcaaccagactcaagaggaccgccagaagaaggtacacaaggcgcaagaacaggatctgctacctccaggagatcttcagtaacgagatggcaaaggtcgacgactctttcttccacaggctcgaggaatccttcctcgtcgaggaggacaagaagcatgagagacaccccatcttcggaaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtcgcctaccacgagaagtacccaaccatctaccacctgaggaagaagctcgtcgacagtaccgacaaggctgacctcaggctcatctacctcgcactcgcccacatgattaagttcaggggccacttcctcatagagggagacctcaacccagacaactccgacgtcgacaaactcttcatccaactcgtgcagacctacaatcaactctttgaagagaacccaatcaacgcctccggagtggatgctaaggctatattgtccgccaggctctccaaatcaagacgcctcgaaaacctcatcgcccagctcccaggggagaagaaaaatagcctcttcgggaacctcatagccctgtcccttggactcacccctaacttcaaatcaaatttcgacctcgcagaggacgctaagcttcaactctccaaggacacctacgacgacgacctcgataacctcctcgcccaaatcggtgatcaatacgctgacctcttcctcgctgctaagaacctctccgacgccatactcctctccgacattctgagggtcaacaccgagatcacaaaggctcccttgtccgcctccatgattaaacgctacgacgaacaccaccaggacctcaccctcttgaaggcactggttagacagcagctccccgagaagtacaaggaaatcttcttcgaccaatcaaaaaacggctacgccggatacatcgacggaggagcatcccaggaagagttctacaagttcatcaaaccaattctcgaaaagatggacggaacagaggagctcttggtcaagctcaacagggaggacctcctcagaaagcagagaaccttcgacaacggcagtatcccccaccagatccaccttggagagttgcacgcaatcctcaggaggcaagaggacttctaccccttcctcaaggacaacagggagaagatcgagaagatccttacattccgcatcccctactacgtcggacctttggcaagaggaaactcccgcttcgcatggatgactcgcaagagtgaggaaaccatcaccccttggaacttcgaggaggtcgtcgataagggagcttcagcccagtccttcatcgagcgcatgaccaacttcgataaaaatctccccaatgaaaaagtcctccccaagcacagtctgctctacgagtacttcacagtctacaacgagctcaccaaggtcaagtacgtcaccgaaggcatgagaaaacccgccttcctcagtggcgagcagaagaaggcaatcgtggacttgctgttcaagaccaaccgcaaggtcacagtcaagcaattaaaagaggactacttcaagaaaatagagtgcttcgacagtgtcgagatctctggggtcgaggacaggttcaacgcatccttggggacctatcacgacctcctcaagatcattaaagacaaggacttcctcgacaacgaggagaacgaggacatactggaggacatcgtcctcaccctcactctctttgaggacagggagatgatagaggagcgcctcaaaacctacgcccacctcttcgacgacaaggtgatgaaacagctcaagaggcgcagatacaccggatggggtagactctccaggaagctgattaatggcatccgcgacaaacagtccggcaagaccatcctcgacttcctcaagagtgacggattcgccaaccgcaacttcatgcagctcatacacgacgactccctcaccttcaaggaggacatccaaaaagcccaagtctccggacagggagactcattgcacgaacacatcgccaacttggctggatctcctgctattaaaaagggcatcctccaaaccgtcaaggtggtcgacgaactcgtcaaggtcatgggtagacacaagcccgaaaatatcgtcatcgagatggcaagggagaaccagacaacccagaagggccaaaaaaactccagggagcgcatgaaacgcatcgaggagggaataaaggagctcgggtcccagatcctcaaggagcaccccgtcgaaaatactcaactccagaatgaaaagctctacctctactacctccaaaacggcagggatatgtacgtcgaccaagagctcgacattaatcgcctctccgactacgacgtcgatcacatcgtcccccagagtttcctcaaggacgactccatcgacaacaaggtcctcaccagatccgataaaaatcgcggaaagtccgacaacgtcccctctgaggaagtggttaagaagatgaaaaactactggagacagctcctcaacgcaaagctgatcacccagcgcaagttcgacaacctcacaaaggctgagagagggggactctctgagttggacaaggccggcttcatcaagagacaactcgtggaaacccgccagatcaccaagcatgtcgcacagattctcgactcccgcatgaatactaaatacgatgaaaatgacaagctcatcagggaggtcaaggtcatcaccctgaagtccaagctcgtctccgacttccgcaaggacttccagttctacaaggtccgcgagatcaacaactaccaccacgcccacgacgcatacctcaacgctgtggttggaacagcactcatcaagaagtaccccaagctcgagtccgagttcgtctacggcgactacaaggtctacgacgtcaggaagatgatcgccaagtccgagcaagagatcggaaaggccaccgcaaaatatttcttctactccaacataatgaacttcttcaaaaccgagatcaccctggctaacggagaaataaggaagaggcccctgatagaaaccaacggcgagacaggcgagattgtctgggacaaaggcagggacttcgcaaccgtcagaaaggtgctcagtatgcctcaggtcaacatagtcaaaaagaccgaagtccagactggaggattctccaaggagtccatcctccccaaaaggaactccgacaaactgatcgccaggaaaaaggactgggaccccaaaaaatatggcggcttcgactcccctactgttgcttacagtgtgctcgtcgtcgcaaaagtcgagaaggggaaatccaagaagctcaagtcagtgaaggagctcctcggcatcaccatcatggagaggtcctccttcgagaagaaccccatcgacttcctcgaggccaagggatataaggaggtcaagaaggacctcatcattaaactccccaagtactccctcttcgagctcgaaaacggacgcaagaggatgctcgcttcagctggtgaactccagaagggcaacgaactcgctttgccctctaaatacgtcaacttcctctacctcgcctcccactatgaaaagctcaagggctccccagaggacaacgagcagaagcaactcttcgtcgagcagcacaagcattacctcgacgagatcatcgagcagatctccgagttctccaagagagtcatcctcgctgacgcaaacctcgacaaggtcctcagtgcatataacaagcaccgcgacaaaccaataagggagcaggccgaaaatattatacacctgttcaccctcaccaacttgggagcaccagccgccttcaagtatttcgacaccaccatcgacagaaagcgctacacctccacaaaggaggtcctggacgccacacttatccaccagtccatcaccggcctctatgaaacacgcatcgacctctctcaattgggaggggacaagagaccaagagacagacacgatggagagcttggaggtagaaagagagcaaggtagttcgaactggccaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttggcgcgccgttaacttaacggcaaacgctaattagtcactaggcccaggaaacactaactaagccctagcttatcctagcgcaacctagttaggtcttggtaacccgggtaccctgggatccgatatcgatgggccctggccgaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataaccatgccacacaacacaatggcggccaccgcttccagaaccacccgattctcttcttcctcttcacaccccaccttccccaaacgcattactagatccaccctccctctctctcatcaaaccctcaccaaacccaaccacgctctcaaaatcaaatgttccatctccaaaccccccacggcggcgcccttcaccaaggaagcgccgaccacggagcccttcgtgtcacggttcgcctccggcgaacctcgcaagggcgcggacatccttgtggaggcgctggagaggcagggcgtgacgacggtgttcgcgtaccccggcggtgcgtcgatggagatccaccaggcgctcacgcgctccgccgccatccgcaacgtgctcccgcgccacgagcagggcggcgtcttcgccgccgaaggctacgcgcgttcctccggcctccccggcgtctgcattgccacctccggccccggcgccaccaacctcgtgagcggcctcgccgacgctttaatggacagcgtcccagtcgtcgccatcaccggccaggtcgcccgccggatgatcggcaccgacgccttccaagaaaccccgatcgtggaggtgagcagatccatcacgaagcacaactacctcatcctcgacgtcgacgacatcccccgcgtcgtcgccgaggctttcttcgtcgccacctccggccgccccggtccggtcctcatcgacattcccaaagacgttcagcagcaactcgccgtgcctaattgggacgagcccgttaacctccccggttacctcgccaggctgcccaggccccccgccgaggcccaattggaacacattgtcagactcatcatggaggcccaaaagcccgttctctacgtcggcggtggcagtttgaattccagtgctgaattgaggcgctttgttgaactcactggtattcccgttgctagcactttaatgggtcttggaacttttcctattggtgatgaatattcccttcagatgctgggtatgcatggtactgtttatgctaactatgctgttgacaatagtgatttgttgcttgcctttggggtaaggtttgatgaccgtgttactgggaagcttgaggcttttgctagtagggctaagattgttcacattgatattgattctgccgagattgggaagaacaagcaggcgcacgtgtcggtttgcgcggatttgaagttggccttgaagggaattaatatgattttggaggagaaaggagtggagggtaagtttgatcttggaggttggagagaagagattaatgtgcagaaacacaagtttccattgggttacaagacattccaggacgcgatttctccgcagcatgctatcgaggttcttgatgagttgactaatggagatgctattgttagtactggggttgggcagcatcaaatgtgggctgcgcagttttacaagtacaagagaccgaggcagtggttgacctcagggggtcttggagccatgggttttggattgcctgcggctattggtgctgctgttgctaaccctggggctgttgtggttgacattgatggggatggtagtttcatcatgaatgttcaggagttggccactataagagtggagaatctcccagttaagatattgttgttgaacaatcagcatttgggtatggtggttcagttggaggataggttctacaagtccaatagagctcacacctatcttggagatccgtctagcgagagcgagatattcccaaacatgctcaagtttgctgatgcttgtgggataccggcagcgcgagtgacgaagaaggaagagcttagagcggcaattcagagaatgttggacacccctggcccctaccttcttgatgtcattgtgccccatcaggagcatgtgttgccgatgattcccagtaatggatccttcaaggatgtgataactgagggtgatggtagaacgaggtactgattgcctagaccaaatgttccttgatgcttgttttgtacaatatatataagataatgctgtcctagttgcaggatttggcctgtggtgagcatcatagtctgtagtagttttggtagcaagacattttattttccttttatttaacttactacatgcagtagcatctatctatctctgtagtctgatatctcctgttgtctgtattgtgccgttggattttttgctgtagtgagactgaaaatgatgtgctagtaataatatttctgttagaaatctaagtagagaatctgttgaagaagtcaaaagctaatggaatcaggttacatattcaatgtttttctttttttagcggttggtagacgtgtagattcaacttctcttggagctcacctaggcaatcagtaaaatgcatattccttttttaacttgccatttatttacttttagtggaaattgtgaccaatttgttcatgtagaacggatttggaccattgcgtccacaaaacgtctcttttgctcgatcttcacaaagcgataccgaaatccagagatagttttcaaaagtcagaaatggcaaagttataaatagtaaaacagaatagatgctgtaatcgacttcaataacaagtggcatcacgtttctagttctagacccatcagctgaggtacaaattaattaataagtgactagggtcacgtgaccctagtcacttatgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttctagctagctaagtttaaacggccggccaaacgtgcaagcgctactagacaattcagtacattaaaaacgtccgcaatgtgttattaagttgtctaagcgtcaatttatttacaattgaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggcgcgcgcggtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaacgcgcgcgggcgcgccttttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatggcgcgccggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtaggaacagtgaattggagttcgtcttgttataattagcttcttgggggatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatacttcgctcgtgaaaagcagcgctcagggggctagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtacgttggaatcgcttctacaaaa

SEQ ID NO: 63 - DNA, 10993 bp, Artificial
  Vector 18
ggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttactaccggctggatggcggggccttgatcgtgcaccgccggcgtccggaggttaccggccagaatggcccggaccgaagactctcggtccgaagcttgcgatagcggccgcgggcataatgaggatcgaggatgaggagcatgcacggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaccatcgaggggtacctcactgactagctaatcgagctagttaccctatgaggtgacatgaagcgctcacggttactatgacggttagcttcacgactgttggtggcagtagcgtacgacttagctatagttccggacttaccgataacttcgtatagcatacattatacgaagttatggcgccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattcttcaaaaagtataggaacttctgtacacctgagctgattccgatgacttcgtaggttcctagctcaagccgctcgtgtccaagcgtcacttacgattagctaatgattacggcatctaggaccgactagctaactaactagggcgcgccatgaggagcaatcattgttcaagacatgatgcaaagctagaaaactttgattgtggccgtccttgtgaagtttaggccggggggaacttcatgaaccctatcgaagcttaattagttcttttttgttgttagccatgtttgtattgtagttaaggtgaacaacatgacgccgcacccgcgatctcagggctcgtccccacacaggagggcacgtcgtcgtcttcgccgccgagcatcagagattcagagcacatacacgcacatctcaagcaaacggagtagtacgtcctactcctacgtacatacctagccgacgacctttatgtgcacaccaccactgctctgctgcccggcctctccgtcgtccgttcatcaccacctcatcctcgatcctcattatgccccggggattagaattaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacagtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcagggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtcccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaag

SEQ ID NO: 64 - DNA, 10945 bp, Artificial
  Vector 19
ggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttactaccggctggatggcggggccttgatcgtgcaccgccggcgtccggaggttaccggccagaatggcccggaccgaagactctcggtccgaagcttgcgatagcggccgcggagcatgcacggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaccatcgaggggtacctcactgactagctaatcgagctagttaccctatgaggtgacatgaagcgctcacggttactatgacggttagcttcacgactgttggtggcagtagcgtacgacttagctatagttccggacttaccgataacttcgtatagcatacattatacgaagttatggcgccgctagcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccctagcgtatacgaagttcctattccgaagttcctattcttcaaaaagtataggaacttctgtacacctgagctgattccgatgacttcgtaggttcctagctcaagccgctcgtgtccaagcgtcacttacgattagctaatgattacggcatctaggaccgactagctaactaactagggcgcgccatgaggagcaatcattgttcaagacatgatgcaaagctagaaaactttgattgtggccgtccttgtgaagtttaggccggggggaacttcatgaaccctatcgaagcttaattagttcttttttgttgttagccatgtttgtattgtagttaaggtgaacaacatgacgccgcacccgcgatctcagggctcgtccccacacaggagggcacgtcgtcgtcttcgccgccgagcatcagagattcagagcacatacacgcacatctcaagcaaacggagtagtacgtcctactcctacgtacatacctagccgacgacctttatgtgcacaccaccactgctctgctgcccggcctctccgtcgtccgttcatcaccacccggggattagaattaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacagtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcagggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtcccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaag

SEQ ID NO: 65 - DNA, 23913 bp, Artificial
  Vector 25
agaaacaatcaaacaaacatacacagcgatttattcacacgaacccgaattacaacggtatatatcctgtcagccaacaccaaaacatcaaaaaaatcgggatcaggatcaggatctgcggccgcatcctgcaggagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaacgaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacctagctaggttacctcgagcgacttatgcttctatagggcccagattggaattcatagtctatgcattccatcttgaggggagggtattagattatggttaagtgatggtttaataactggtttagcttccttttactaaaccggttatataaatacatcctcttgtacattgtaaactttaacttgagcaatatactttttccttttcatcgtaacatactttccccattgatcttgagctcaagttctaataaacatattacgtaacgggtttattttgtcgtcaacacattatcggcaatgtgaaaagaaggggtgaggtatctccatttcaattcttctctttatatattaatcgaattatttacgtatgaaatgaacgtttatatagaaatttcgtgtggaaaacgacatgtacacggcatctcaagaccaattagtaatatactttagtggtgattacatgtttacttatccaattgagaatttaaagcatcgacaataccttaatgtcgattaagccgtccccacttcatgtaatgagttatggggggagagagagatcccgaaattcgtcaaataaaacaacttagaactaaaaaccgacaccaagtatcataaaggaaatgttgaagaagtcatttatcgtatccagctcacaattcctaagattaaatcatgaccgttggaagagcttataagattaaactgaagaaattgtgggttttagaagaaagacaagaaagagaagaacatgatcttacattgcctattttggtgtataggagttgtcaaaaagaggagagagaggagacaattaggtcaaataaatgagcactaaaaatggagacatgtgttgagtaactattacaagagcgacttatgcttctagccagaatggccatctggattcagcagggggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagccatggctgcaactactcttacatctgctttacctggtgctttcagttcatcccagagaccaagtgctcctttcaacttacaaagatcacctagagtgcttagaaggttcaacagaaagacaggacgtcaacctcgtggacttgttcgtgctgcaaaggctcaagcggcgcaaaacctgccagagaaattcgatgaaacaagactctgggaggccctcaggggatttggggttagtccaagtagggttacttacgctcccgtcggattcggagattaccactggaccgtcacagatgaagacgggagaccttggttcgcaactgtcagtgacctcgaacacaaagagcattgcgggcagggagcacaagcagcccttaaaggactcagacaagctatggacactgccctcgcacttagagatagggacggactcagattcgtggttgctccagtggcagcaacagatgggggtggccctgtccttccccttgacgctaggtatgcactcacagtcttccctcacgtcccaggaagaacaggagagttcggacaaagactcacagaggcagagagggacagactgcttgctcttctggcagaactccacggaagaacacctcctgaaacaaccccaccagccgatatggaaccaccaggacttcctggtgttagagcagcactcgccgaaagtgaaggaccttggagtggaggaccatttgcagaacccgctagacttcttctcagagaacacgaggccacactgcacgcaagactcgctgaattcgaagccctcgtcgcaagagttaagggtcgtggagcacctcttgtcgttacccacggagaaccacacccaggcaacttgatcctcggagaggaaggctatctcctcgtggactgggatacagttggactggctccagctgaaagggatttgagtctcatctcagacgacccagctgacctcgcaagatacgcagagcttacaggaagaactccagacccagacgcactcgcactctatagactgcgttggagtctccttgatgtggctgagttcgtcgagtggttcagggctgaacaccaaagaacccaagacaccgagagtgcatggaaggggttcactgacacacttgggcaattggctgctggtggatcagctgcatagcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagaggtaccctggcatatggcaatgatatcatcaccaaagtgcaatgcccctttttgccctagtttcgtaaagtctctctccttcttcgtccttaggaaaaaccctaaattaaatcctgtgttcttgatctttctttttgagtaaccatgattttgaccacacactagttcttctatattttgtggtctataggattttgctttatatgtgtttcttgtattgctccgtacgtgcgtatataaatttaaatggttacaacaaggtttattataaataggcacaaattagtccatgaagttatttagcttgcacaagtataatttgttaagtatttaaatatataaatttgttacaaaacttaattaaatttatctgattatattttctttagtgttcttcctttgccaacgttgaggtagctattattattattattttgaacattatgtacgtagttatcttggctagttatgattcgaattcttaatttggatcacacttaacagtatttaaaatattcttagaactaaaataattaagagttacctttaaattgaagtattcgtgctaaacagaaactagaataaacaaatgattgcatgttaattttttttttcgattttcctatcagaataaacacatgattgcatgcaaattttgtttttgattacgttatcttttgtttattttagttttgatgctaattaatattttttattaacaactcacatacattctacctgattctaggtcagataatgacacagcgcaacaaaattaatacaaaaccttcggaaagtagaataccgcagaagtaacttttttgggtacatacgaaatacagtgaaatctctataaattaataagcttggcgcgccgctcgagcgacttatgcttctatagggtacccgggcttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgagcgacttatgcttctatagttttagagctagaaatagcaagttaaaataaggctagtccgttatcaacttgaaaaagtggcaccgagtcggtgcttttttttttgtctaaaaacggcccctaactaacgcttagttgcccgctagattagtcccccgttagtgcctagttagacacacgacgaactaggggctagcggccgctctagaaagcttagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagcggccgggatccatggcacctaaaaagaagaggaaagttatggacaaaaagtactccatagggctcgatatcggcacaaacagtgtggggtgggcagtcatcactgacgactacaaggtcccctccaagaagttcaaggtcctcggcaatacagaccgccactccatcaagaagaacctcatcggagcactgttgttcgactccggagaaactgccgaagcaaccagactcaagaggaccgccagaagaaggtacacaaggcgcaagaacaggatctgctacctccaggagatcttcagtaacgagatggcaaaggtcgacgactctttcttccacaggctcgaggaatccttcctcgtcgaggaggacaagaagcatgagagacaccccatcttcggaaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtcgcctaccacgagaagtacccaaccatctaccacctgaggaagaagctcgtcgacagtaccgacaaggctgacctcaggctcatctacctcgcactcgcccacatgattaagttcaggggccacttcctcatagagggagacctcaacccagacaactccgacgtcgacaaactcttcatccaactcgtgcagacctacaatcaactctttgaagagaacccaatcaacgcctccggagtggatgctaaggctatattgtccgccaggctctccaaatcaagacgcctcgaaaacctcatcgcccagctcccaggggagaagaaaaatagcctcttcgggaacctcatagccctgtcccttggactcacccctaacttcaaatcaaatttcgacctcgcagaggacgctaagcttcaactctccaaggacacctacgacgacgacctcgataacctcctcgcccaaatcggtgatcaatacgctgacctcttcctcgctgctaagaacctctccgacgccatactcctctccgacattctgagggtcaacaccgagatcacaaaggctcccttgtccgcctccatgattaaacgctacgacgaacaccaccaggacctcaccctcttgaaggcactggttagacagcagctccccgagaagtacaaggaaatcttcttcgaccaatcaaaaaacggctacgccggatacatcgacggaggagcatcccaggaagagttctacaagttcatcaaaccaattctcgaaaagatggacggaacagaggagctcttggtcaagctcaacagggaggacctcctcagaaagcagagaaccttcgacaacggcagtatcccccaccagatccaccttggagagttgcacgcaatcctcaggaggcaagaggacttctaccccttcctcaaggacaacagggagaagatcgagaagatccttacattccgcatcccctactacgtcggacctttggcaagaggaaactcccgcttcgcatggatgactcgcaagagtgaggaaaccatcaccccttggaacttcgaggaggtcgtcgataagggagcttcagcccagtccttcatcgagcgcatgaccaacttcgataaaaatctccccaatgaaaaagtcctccccaagcacagtctgctctacgagtacttcacagtctacaacgagctcaccaaggtcaagtacgtcaccgaaggcatgagaaaacccgccttcctcagtggcgagcagaagaaggcaatcgtggacttgctgttcaagaccaaccgcaaggtcacagtcaagcaattaaaagaggactacttcaagaaaatagagtgcttcgacagtgtcgagatctctggggtcgaggacaggttcaacgcatccttggggacctatcacgacctcctcaagatcattaaagacaaggacttcctcgacaacgaggagaacgaggacatactggaggacatcgtcctcaccctcactctctttgaggacagggagatgatagaggagcgcctcaaaacctacgcccacctcttcgacgacaaggtgatgaaacagctcaagaggcgcagatacaccggatggggtagactctccaggaagctgattaatggcatccgcgacaaacagtccggcaagaccatcctcgacttcctcaagagtgacggattcgccaaccgcaacttcatgcagctcatacacgacgactccctcaccttcaaggaggacatccaaaaagcccaagtctccggacagggagactcattgcacgaacacatcgccaacttggctggatctcctgctattaaaaagggcatcctccaaaccgtcaaggtggtcgacgaactcgtcaaggtcatgggtagacacaagcccgaaaatatcgtcatcgagatggcaagggagaaccagacaacccagaagggccaaaaaaactccagggagcgcatgaaacgcatcgaggagggaataaaggagctcgggtcccagatcctcaaggagcaccccgtcgaaaatactcaactccagaatgaaaagctctacctctactacctccaaaacggcagggatatgtacgtcgaccaagagctcgacattaatcgcctctccgactacgacgtcgatcacatcgtcccccagagtttcctcaaggacgactccatcgacaacaaggtcctcaccagatccgataaaaatcgcggaaagtccgacaacgtcccctctgaggaagtggttaagaagatgaaaaactactggagacagctcctcaacgcaaagctgatcacccagcgcaagttcgacaacctcacaaaggctgagagagggggactctctgagttggacaaggccggcttcatcaagagacaactcgtggaaacccgccagatcaccaagcatgtcgcacagattctcgactcccgcatgaatactaaatacgatgaaaatgacaagctcatcagggaggtcaaggtcatcaccctgaagtccaagctcgtctccgacttccgcaaggacttccagttctacaaggtccgcgagatcaacaactaccaccacgcccacgacgcatacctcaacgctgtggttggaacagcactcatcaagaagtaccccaagctcgagtccgagttcgtctacggcgactacaaggtctacgacgtcaggaagatgatcgccaagtccgagcaagagatcggaaaggccaccgcaaaatatttcttctactccaacataatgaacttcttcaaaaccgagatcaccctggctaacggagaaataaggaagaggcccctgatagaaaccaacggcgagacaggcgagattgtctgggacaaaggcagggacttcgcaaccgtcagaaaggtgctcagtatgcctcaggtcaacatagtcaaaaagaccgaagtccagactggaggattctccaaggagtccatcctccccaaaaggaactccgacaaactgatcgccaggaaaaaggactgggaccccaaaaaatatggcggcttcgactcccctactgttgcttacagtgtgctcgtcgtcgcaaaagtcgagaaggggaaatccaagaagctcaagtcagtgaaggagctcctcggcatcaccatcatggagaggtcctccttcgagaagaaccccatcgacttcctcgaggccaagggatataaggaggtcaagaaggacctcatcattaaactccccaagtactccctcttcgagctcgaaaacggacgcaagaggatgctcgcttcagctggtgaactccagaagggcaacgaactcgctttgccctctaaatacgtcaacttcctctacctcgcctcccactatgaaaagctcaagggctccccagaggacaacgagcagaagcaactcttcgtcgagcagcacaagcattacctcgacgagatcatcgagcagatctccgagttctccaagagagtcatcctcgctgacgcaaacctcgacaaggtcctcagtgcatataacaagcaccgcgacaaaccaataagggagcaggccgaaaatattatacacctgttcaccctcaccaacttgggagcaccagccgccttcaagtatttcgacaccaccatcgacagaaagcgctacacctccacaaaggaggtcctggacgccacacttatccaccagtccatcaccggcctctatgaaacacgcatcgacctctctcaattgggaggggacaagagaccaagagacagacacgatggagagcttggaggtagaaagagagcaaggtagttcgaactggccaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttggcgcgccgttaacttaacggcaaacgctaattagtcactaggcccaggaaacactaactaagccctagcttatcctagcgcaacctagttaggtcttggtaaccgcgatcgcgctgacaagcggtatttaaatcatcattctaggcgcgccacttacgcttgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccaaacgtgcaagcgctactagacaattcagtacattaaaaacgtccgcaatgtgttattaagttgtctaagcgtcaatttatttacaattgaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggcgcgcgcggtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaacgcgcgcgggcgcgccttttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatggcgcgccggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtaggaacagtgaattggagttcgtcttgttataattagcttcttgggggatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatacttcgctcgtgaaaagcagcgctcagggggctagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtacgttggaatcgcttctacaaaactcac

SEQ ID NO: 66 - DNA, 29595 bp, Artificial
  Vector 26
agattatcaaaaaggatcttcacctagatccttttaaattaaaaatgaagcgtacgttggaatcgcttctacaaaactcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaacgaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacctagctaggttaccactcgagcgacttatgcttctatagggaagcggccgcgaattccagaagaccaaagggcaattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacccatggaaactcaacaacaacaagcagatattcaagattttgggaacaaaaacagtaacacctatgcatgcaggcaaagcagtactaggtggacacccacaagtgatcagatcagaatactgaaagagctctactacaacaatggaatcagatcaccaactgctgatcagattcagagaatcgctgctcaactcagacagtacggcaagattgaaggcaagaacgtgttttattggtttcagaaccataaagctcgtgaacgccagaagaaacggttcactcctactgctcctccaccaccgtctcacttctccgatcatattaaccaccatcttcccaacgctgcccccatgcagattccgtctcaccaccaccactaccaccatcaagaaccaccacatgtctatgctcaccctcacaaactctacaccactcatcacattggggttggttcttcttcacaaggagtgatgggtgtagggtgtggctatggatctgttgctatggagaagagtttcaggaagtgttcaatatcaccaccgggagagagtaaggccacaggaggaattggccggaatatcggttcaagatcacggataagtgtcgattcgtgttccttcttcgacacaattaagccaaagacatatgagatgtttgagaatcatgatcaagatgaagaacaaggagagccttcaactgagatcgaaacacttccattattcccgattcacgacggcaaccatcatgatttcttcggcatgaggacggcaaatctgcaattggagcaaggcactggaggttactacactggaggaagctggtatcggtctgatgagagggcgtctcttgagctcagtctcaactcatatggttattataactaattcgaactggccaggtacctgacatcttatagtctgcaacctctcgtgtctgaattcctatctttatcaagtgttattgcttccacgactataggacagctttcgtcgaaaggttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccaagcttggcgcgccggtcacccggtccgggcctagaaggccacccggggctcggcgttaggcttttagtccgctaggtggctagaccgaggttaggacgctagttcactaggggcctagtggtgttttaaggatgggcaagtttgtacaaaaaagcaggctggcgccggaaccaattcagtcgagtgcggccgcctctagattggaattcatagtctatgcattccatcttgaggggagggtattagattatggttaagtgatggtttaataactggtttagcttccttttactaaaccggttatataaatacatcctcttgtacattgtaaactttaacttgagcaatatactttttccttttcatcgtaacatactttccccattgatcttgagctcaagttctaataaacatattacgtaacgggtttattttgtcgtcaacacattatcggcaatgtgaaaagaaggggtgaggtatctccatttcaattcttctctttatatattaatcgaattatttacgtatgaaatgaacgtttatatagaaatttcgtgtggaaaacgacatgtacacggcatctcaagaccaattagtaatatactttagtggtgattacatgtttacttatccaattgagaatttaaagcatcgacaataccttaatgtcgattaagccgtccccacttcatgtaatgagttatggggggagagagagatcccgaaattcgtcaaataaaacaacttagaactaaaaaccgacaccaagtatcataaaggaaatgttgaagaagtcatttatcgtatccagctcacaattcctaagattaaatcatgaccgttggaagagcttataagattaaactgaagaaattgtgggttttagaagaaagacaagaaagagaagaacatgatcttacattgcctattttggtgtataggagttgtcaaaaagaggagagagaggagacaattaggtcaaataaatgagcactaaaaatggagacatgtgttgagtaactattacaagagcgacttatgcttctagagtggccatctggattcagcagggggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagccatggctgcaactactcttacatctgctttacctggtgctttcagttcatcccagagaccaagtgctcctttcaacttacaaagatcacctagagtgcttagaaggttcaacagaaagacaggacgtcaacctcgtggacttgttcgtgctgcaaaggctcaagcggcgcaaaacctgccagagaaattcgatgaaacaagactctgggaggccctcaggggatttggggttagtccaagtagggttacttacgctcccgtcggattcggagattaccactggaccgtcacagatgaagacgggagaccttggttcgcaactgtcagtgacctcgaacacaaagagcattgcgggcagggagcacaagcagcccttaaaggactcagacaagctatggacactgccctcgcacttagagatagggacggactcagattcgtggttgctccagtggcagcaacagatgggggtggccctgtccttccccttgacgctaggtatgcactcacagtcttccctcacgtcccaggaagaacaggagagttcggacaaagactcacagaggcagagagggacagactgcttgctcttctggcagaactccacggaagaacacctcctgaaacaaccccaccagccgatatggaaccaccaggacttcctggtgttagagcagcactcgccgaaagtgaaggaccttggagtggaggaccatttgcagaacccgctagacttcttctcagagaacacgaggccacactgcacgcaagactcgctgaattcgaagccctcgtcgcaagagttaagggtcgtggagcacctcttgtcgttacccacggagaaccacacccaggcaacttgatcctcggagaggaaggctatctcctcgtggactgggatacagttggactggctccagctgaaagggatttgagtctcatctcagacgacccagctgacctcgcaagatacgcagagcttacaggaagaactccagacccagacgcactcgcactctatagactgcgttggagtctccttgatgtggctgagttcgtcgagtggttcagggctgaacaccaaagaacccaagacaccgagagtgcatggaaggggttcactgacacacttgggcaattggctgctggtggatcagctgcatagcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagaggtaccggcggccgccatatggcaatgatatcatcaccaaagtgcaatgcccctttttgccctagtttcgtaaagtctctctccttcttcgtccttaggaaaaaccctaaattaaatcctgtgttcttgatctttctttttgagtaaccatgattttgaccacacactagttcttctatattttgtggtctataggattttgctttatatgtgtttcttgtattgctccgtacgtgcgtatataaatttaaatggttacaacaaggtttattataaataggcacaaattagtccatgaagttatttagcttgcacaagtataatttgttaagtatttaaatatataaatttgttacaaaacttaattaaatttatctgattatattttctttagtgttcttcctttgccaacgttgaggtagctattattattattattttgaacattatgtacgtagttatcttggctagttatgattcgaattcttaatttggatcacacttaacagtatttaaaatattcttagaactaaaataattaagagttacctttaaattgaagtattcgtgctaaacagaaactagaataaacaaatgattgcatgttaattttttttttcgattttcctatcagaataaacacatgattgcatgcaaattttgtttttgattacgttatcttttgtttattttagttttgatgctaattaatattttttattaacaactcacatacattctacctgattctaggtcagataatgacacagcgcaacaaaattaatacaaaaccttcggaaagtagaataccgcagaagtaacttttttgggtacatacgaaatacagtgaaatctctataaattaatcgatgcggccgcctaactaactaggggtttacttattttgtgggtatctatacttttattagatttttaatcaggctcctgatttctttttatttcgattcaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatgtgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaaggttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctaggttaagtaatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgacgaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtacctagatcttgttaactgagctcttttgtgatctgatgataagtggttggttcgtgtctcatgcacttgggaggtgatctatttcacctggtgtagtttgtgtttccgtcagttggaaaaacttatccctatcgatttcgttttcattttctgcttttcttttatgtaccttcgtttgggcttgtaacgggcctttgtatttcaactctcaataataatccaagtgcatgttaaacaatttgtcatctgtttcggctttgatatactactggtgaagatgggccgtactactgcatcacaacgaaaaataataataagatgaaaaacttgaagtggaaaaaaaaaaaaacttgaatgttcactactactcattgaccataatgtttaacatacatagctcaatagtatttttgtgaatatggcaacacaaacagtccaaaacaattgtctcttactataccaaaccaagggcgccgcttgtttgccactctttgtgtgcaatagtgtgattaccacatctccacattcaatatattccctgaattatctgacgattttgatggctcactgttttcccaagtcttgaattgtcttctgtgcgccagtcaaatgcatatgtgttgagtttatcttttaaatatcaagcttttgtttttaacttttgtttgtaaccaaaaactcacagtaggagtttgatcacataattttatgtttgcctttgcaatttctagtgagtctttgattaaaagcttgaaaagaaaatgcagccaagcttaccaagtaagttatgtgtattaaccagaggaagagagaatcttgcaaaatttcaacaaacacaaaaagaagtattactacgattggtggagaaagaaaacgattccaaatcttgaactgttgttgtaaaagcatagcagaaagtgggagacaaccgaaatagaaatgactataacttaatttaatgttatcattataatttcttctagcaaatatttagaaagtaaatatcacatcaacctttaatgtaattaagctttctctttttgattcatgtgagatgaaaagaaaaaaaagaagagaaaagtgtagaaaacacatcatttctaagctgaagaagcttgggcgcgccgctcgagcgacttatgcttctatagggtacccgggcttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgagcgacttatgcttctatagttttagagctagaaatagcaagttaaaataaggctagtccgttatcaacttgaaaaagtggcaccgagtcggtgcttttttttttgtctaaaaacggcccctaactaacgcttagttgcccgctagattagtcccccgttagtgcctagttagacacacgacgaactaggggctagcggccgctctagaaagcttagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagcggccgggatccatggcacctaaaaagaagaggaaagttatggacaaaaagtactccatagggctcgatatcggcacaaacagtgtggggtgggcagtcatcactgacgactacaaggtcccctccaagaagttcaaggtcctcggcaatacagaccgccactccatcaagaagaacctcatcggagcactgttgttcgactccggagaaactgccgaagcaaccagactcaagaggaccgccagaagaaggtacacaaggcgcaagaacaggatctgctacctccaggagatcttcagtaacgagatggcaaaggtcgacgactctttcttccacaggctcgaggaatccttcctcgtcgaggaggacaagaagcatgagagacaccccatcttcggaaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtcgcctaccacgagaagtacccaaccatctaccacctgaggaagaagctcgtcgacagtaccgacaaggctgacctcaggctcatctacctcgcactcgcccacatgattaagttcaggggccacttcctcatagagggagacctcaacccagacaactccgacgtcgacaaactcttcatccaactcgtgcagacctacaatcaactctttgaagagaacccaatcaacgcctccggagtggatgctaaggctatattgtccgccaggctctccaaatcaagacgcctcgaaaacctcatcgcccagctcccaggggagaagaaaaatagcctcttcgggaacctcatagccctgtcccttggactcacccctaacttcaaatcaaatttcgacctcgcagaggacgctaagcttcaactctccaaggacacctacgacgacgacctcgataacctcctcgcccaaatcggtgatcaatacgctgacctcttcctcgctgctaagaacctctccgacgccatactcctctccgacattctgagggtcaacaccgagatcacaaaggctcccttgtccgcctccatgattaaacgctacgacgaacaccaccaggacctcaccctcttgaaggcactggttagacagcagctccccgagaagtacaaggaaatcttcttcgaccaatcaaaaaacggctacgccggatacatcgacggaggagcatcccaggaagagttctacaagttcatcaaaccaattctcgaaaagatggacggaacagaggagctcttggtcaagctcaacagggaggacctcctcagaaagcagagaaccttcgacaacggcagtatcccccaccagatccaccttggagagttgcacgcaatcctcaggaggcaagaggacttctaccccttcctcaaggacaacagggagaagatcgagaagatccttacattccgcatcccctactacgtcggacctttggcaagaggaaactcccgcttcgcatggatgactcgcaagagtgaggaaaccatcaccccttggaacttcgaggaggtcgtcgataagggagcttcagcccagtccttcatcgagcgcatgaccaacttcgataaaaatctccccaatgaaaaagtcctccccaagcacagtctgctctacgagtacttcacagtctacaacgagctcaccaaggtcaagtacgtcaccgaaggcatgagaaaacccgccttcctcagtggcgagcagaagaaggcaatcgtggacttgctgttcaagaccaaccgcaaggtcacagtcaagcaattaaaagaggactacttcaagaaaatagagtgcttcgacagtgtcgagatctctggggtcgaggacaggttcaacgcatccttggggacctatcacgacctcctcaagatcattaaagacaaggacttcctcgacaacgaggagaacgaggacatactggaggacatcgtcctcaccctcactctctttgaggacagggagatgatagaggagcgcctcaaaacctacgcccacctcttcgacgacaaggtgatgaaacagctcaagaggcgcagatacaccggatggggtagactctccaggaagctgattaatggcatccgcgacaaacagtccggcaagaccatcctcgacttcctcaagagtgacggattcgccaaccgcaacttcatgcagctcatacacgacgactccctcaccttcaaggaggacatccaaaaagcccaagtctccggacagggagactcattgcacgaacacatcgccaacttggctggatctcctgctattaaaaagggcatcctccaaaccgtcaaggtggtcgacgaactcgtcaaggtcatgggtagacacaagcccgaaaatatcgtcatcgagatggcaagggagaaccagacaacccagaagggccaaaaaaactccagggagcgcatgaaacgcatcgaggagggaataaaggagctcgggtcccagatcctcaaggagcaccccgtcgaaaatactcaactccagaatgaaaagctctacctctactacctccaaaacggcagggatatgtacgtcgaccaagagctcgacattaatcgcctctccgactacgacgtcgatcacatcgtcccccagagtttcctcaaggacgactccatcgacaacaaggtcctcaccagatccgataaaaatcgcggaaagtccgacaacgtcccctctgaggaagtggttaagaagatgaaaaactactggagacagctcctcaacgcaaagctgatcacccagcgcaagttcgacaacctcacaaaggctgagagagggggactctctgagttggacaaggccggcttcatcaagagacaactcgtggaaacccgccagatcaccaagcatgtcgcacagattctcgactcccgcatgaatactaaatacgatgaaaatgacaagctcatcagggaggtcaaggtcatcaccctgaagtccaagctcgtctccgacttccgcaaggacttccagttctacaaggtccgcgagatcaacaactaccaccacgcccacgacgcatacctcaacgctgtggttggaacagcactcatcaagaagtaccccaagctcgagtccgagttcgtctacggcgactacaaggtctacgacgtcaggaagatgatcgccaagtccgagcaagagatcggaaaggccaccgcaaaatatttcttctactccaacataatgaacttcttcaaaaccgagatcaccctggctaacggagaaataaggaagaggcccctgatagaaaccaacggcgagacaggcgagattgtctgggacaaaggcagggacttcgcaaccgtcagaaaggtgctcagtatgcctcaggtcaacatagtcaaaaagaccgaagtccagactggaggattctccaaggagtccatcctccccaaaaggaactccgacaaactgatcgccaggaaaaaggactgggaccccaaaaaatatggcggcttcgactcccctactgttgcttacagtgtgctcgtcgtcgcaaaagtcgagaaggggaaatccaagaagctcaagtcagtgaaggagctcctcggcatcaccatcatggagaggtcctccttcgagaagaaccccatcgacttcctcgaggccaagggatataaggaggtcaagaaggacctcatcattaaactccccaagtactccctcttcgagctcgaaaacggacgcaagaggatgctcgcttcagctggtgaactccagaagggcaacgaactcgctttgccctctaaatacgtcaacttcctctacctcgcctcccactatgaaaagctcaagggctccccagaggacaacgagcagaagcaactcttcgtcgagcagcacaagcattacctcgacgagatcatcgagcagatctccgagttctccaagagagtcatcctcgctgacgcaaacctcgacaaggtcctcagtgcatataacaagcaccgcgacaaaccaataagggagcaggccgaaaatattatacacctgttcaccctcaccaacttgggagcaccagccgccttcaagtatttcgacaccaccatcgacagaaagcgctacacctccacaaaggaggtcctggacgccacacttatccaccagtccatcaccggcctctatgaaacacgcatcgacctctctcaattgggaggggacaagagaccaagagacagacacgatggagagcttggaggtagaaagagagcaaggtagttcgaactggccaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttggcgcgccgttaacttaacggcaaacgctaattagtcactaggcccaggaaacactaactaagccctagcttatcctagcgcaacctagttaggtcttggtaaccgcgatcgcgctgacaagcggtatttaaatcatcattctaggcgcgccacttacgcttgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccaaacgtgcaagcgctactagacaattcagtacattaaaaacgtccgcaatgtgttattaagttgtctaagcgtcaatttatttacaattgaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggcgcgcgcggtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaacgcgcgcgggcgcgccttttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatggcgcgccggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtaggaacagtgaattggagttcgtcttgttataattagcttcttgggggatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatacttcgctcgtgaaaagcagcgctcagggggctagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatg

SEQ ID NO: 67 - DNA, 25621 bp, Artificial
  Vector 27
agaaacaatcaaacaaacatacacagcgatttattcacacgaacccgaattacaacggtatatatcctgtcagccaacaccaaaacatcaaaaaaatcgggatcaggatcaggatctgcggccgcatcctgcaggtttaaacggccggccttcactagctagctgctaagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaatcgagctagttaccctatgaggtgacatgaagcgctcacggttactatgacggttagcttcacgactgttggtggcagtagcgtacgacttagctatagttccggacttacctagctaggttacctcgagcgacttatgcttctatagggcccgcggccgccagtgtgatggatatctagattggaattcatagtctatgcattccatcttgaggggagggtattagattatggttaagtgatggtttaataactggtttagcttccttttactaaaccggttatataaatacatcctcttgtacattgtaaactttaacttgagcaatatactttttccttttcatcgtaacatactttccccattgatcttgagctcaagttctaataaacatattacgtaacgggtttattttgtcgtcaacacattatcggcaatgtgaaaagaaggggtgaggtatctccatttcaattcttctctttatatattaatcgaattatttacgtatgaaatgaacgtttatatagaaatttcgtgtggaaaacgacatgtacacggcatctcaagaccaattagtaatatactttagtggtgattacatgtttacttatccaattgagaatttaaagcatcgacaataccttaatgtcgattaagccgtccccacttcatgtaatgagttatggggggagagagagatcccgaaattcgtcaaataaaacaacttagaactaaaaaccgacaccaagtatcataaaggaaatgttgaagaagtcatttatcgtatccagctcacaattcctaagattaaatcatgaccgttggaagagcttataagattaaactgaagaaattgtgggttttagaagaaagacaagaaagagaagaacatgatcttacattgcctattttggtgtataggagttgtcaaaaagaggagagagaggagacaattaggtcaaataaatgagcactaaaaatggagacatgtgttgagtaactattacaagagcgacttatgcttctagatatctcgacttaaaaccttattaagtggcatgggtaacggttcaatatgatcctatcggatcaaaccgggttacatatattattgaacccggttttattggtacgatcgttaagtctcaacatctggctctaataaccgggacgatagagattgtggttagaaataaacggcgttaaaattggttgcagccgcgggcacacggatcgtgtttatcaaataaggcaattagccaaaaaatcgtttcgtgtaaaagttacgtgtcaagctttggttggttattgcttcaccgccttagctttctcgtgaccgactcgtcctcgtctttttttcttcttctataaattaataacctaagacctattcttcttcacaaattcagattccaaatttctcaaactctgaaatcgttctttcaaatctctcaatcgggatcaaggtaaatttctgggttcttattcagtttcttcgattattttccattcgatcgcaatttcgtccctgttctttgagtttgattcggttaatctttgatcggagataaatatctgagtttcatcgctagatctcatctatattctgaactagggttcgtagatttcacagatttgtatatttaggcgtcgattctttgaatttgatccgatatgtgatttatattcagatctggtggtagcttttttaatcggatttgagattatccaagcgattaatctcagttttttgtgaattacagccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattctacatatggcaatgatatcatcaccaaagtgcaatgcccctttttgccctagtttcgtaaagtctctctccttcttcgtccttaggaaaaaccctaaattaaatcctgtgttcttgatctttctttttgagtaaccatgattttgaccacacactagttcttctatattttgtggtctataggattttgctttatatgtgtttcttgtattgctccgtacgtgcgtatataaatttaaatggttacaacaaggtttattataaataggcacaaattagtccatgaagttatttagcttgcacaagtataatttgttaagtatttaaatatataaatttgttacaaaacttaattaaatttatctgattatattttctttagtgttcttcctttgccaacgttgaggtagctattattattattattttgaacattatgtacgtagttatcttggctagttatgattcgaattcttaatttggatcacacttaacagtatttaaaatattcttagaactaaaataattaagagttacctttaaattgaagtattcgtgctaaacagaaactagaataaacaaatgattgcatgttaattttttttttcgattttcctatcagaataaacacatgattgcatgcaaattttgtttttgattacgttatcttttgtttattttagttttgatgctaattaatattttttattaacaactcacatacattctacctgattctaggtcagataatgacacagcgcaacaaaattaatacaaaaccttcggaaagtagaataccgcagaagtaacttttttgggtacatacgaaatacagtgaaatctctataaattaatcgatgcggccgcgctcgagcgacttatgcttctatagggtacccgggcttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgagcgacttatgcttctatagttttagagctagaaatagcaagttaaaataaggctagtccgttatcaacttgaaaaagtggcaccgagtcggtgcttttttttttgtctaaaaacggcccctaactaacgcttagttgcccgctagattagtcccccgttagtgcctagttagacacacgacgaactaggggctagcggccgcggccatctggattcagcagggggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagccatggctgcaactactcttacatctgctttacctggtgctttcagttcatcccagagaccaagtgctcctttcaacttacaaagatcacctagagtgcttagaaggttcaacagaaagacaggacgtcaacctcgtggacttgttcgtgctgcaaaggctcaagcggcgcaaaacctgccagagaaattcgatgaaacaagactctgggaggccctcaggggatttggggttagtccaagtagggttacttacgctcccgtcggattcggagattaccactggaccgtcacagatgaagacgggagaccttggttcgcaactgtcagtgacctcgaacacaaagagcattgcgggcagggagcacaagcagcccttaaaggactcagacaagctatggacactgccctcgcacttagagatagggacggactcagattcgtggttgctccagtggcagcaacagatgggggtggccctgtccttccccttgacgctaggtatgcactcacagtcttccctcacgtcccaggaagaacaggagagttcggacaaagactcacagaggcagagagggacagactgcttgctcttctggcagaactccacggaagaacacctcctgaaacaaccccaccagccgatatggaaccaccaggacttcctggtgttagagcagcactcgccgaaagtgaaggaccttggagtggaggaccatttgcagaacccgctagacttcttctcagagaacacgaggccacactgcacgcaagactcgctgaattcgaagccctcgtcgcaagagttaagggtcgtggagcacctcttgtcgttacccacggagaaccacacccaggcaacttgatcctcggagaggaaggctatctcctcgtggactgggatacagttggactggctccagctgaaagggatttgagtctcatctcagacgacccagctgacctcgcaagatacgcagagcttacaggaagaactccagacccagacgcactcgcactctatagactgcgttggagtctccttgatgtggctgagttcgtcgagtggttcagggctgaacaccaaagaacccaagacaccgagagtgcatggaaggggttcactgacacacttgggcaattggctgctggtggatcagctgcatagcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagaggtaccctgggctctagaaagcttagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagcggccgggatccatggcacctaaaaagaagaggaaagttatggacaaaaagtactccatagggctcgatatcggcacaaacagtgtggggtgggcagtcatcactgacgactacaaggtcccctccaagaagttcaaggtcctcggcaatacagaccgccactccatcaagaagaacctcatcggagcactgttgttcgactccggagaaactgccgaagcaaccagactcaagaggaccgccagaagaaggtacacaaggcgcaagaacaggatctgctacctccaggagatcttcagtaacgagatggcaaaggtcgacgactctttcttccacaggctcgaggaatccttcctcgtcgaggaggacaagaagcatgagagacaccccatcttcggaaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtcgcctaccacgagaagtacccaaccatctaccacctgaggaagaagctcgtcgacagtaccgacaaggctgacctcaggctcatctacctcgcactcgcccacatgattaagttcaggggccacttcctcatagagggagacctcaacccagacaactccgacgtcgacaaactcttcatccaactcgtgcagacctacaatcaactctttgaagagaacccaatcaacgcctccggagtggatgctaaggctatattgtccgccaggctctccaaatcaagacgcctcgaaaacctcatcgcccagctcccaggggagaagaaaaatagcctcttcgggaacctcatagccctgtcccttggactcacccctaacttcaaatcaaatttcgacctcgcagaggacgctaagcttcaactctccaaggacacctacgacgacgacctcgataacctcctcgcccaaatcggtgatcaatacgctgacctcttcctcgctgctaagaacctctccgacgccatactcctctccgacattctgagggtcaacaccgagatcacaaaggctcccttgtccgcctccatgattaaacgctacgacgaacaccaccaggacctcaccctcttgaaggcactggttagacagcagctccccgagaagtacaaggaaatcttcttcgaccaatcaaaaaacggctacgccggatacatcgacggaggagcatcccaggaagagttctacaagttcatcaaaccaattctcgaaaagatggacggaacagaggagctcttggtcaagctcaacagggaggacctcctcagaaagcagagaaccttcgacaacggcagtatcccccaccagatccaccttggagagttgcacgcaatcctcaggaggcaagaggacttctaccccttcctcaaggacaacagggagaagatcgagaagatccttacattccgcatcccctactacgtcggacctttggcaagaggaaactcccgcttcgcatggatgactcgcaagagtgaggaaaccatcaccccttggaacttcgaggaggtcgtcgataagggagcttcagcccagtccttcatcgagcgcatgaccaacttcgataaaaatctccccaatgaaaaagtcctccccaagcacagtctgctctacgagtacttcacagtctacaacgagctcaccaaggtcaagtacgtcaccgaaggcatgagaaaacccgccttcctcagtggcgagcagaagaaggcaatcgtggacttgctgttcaagaccaaccgcaaggtcacagtcaagcaattaaaagaggactacttcaagaaaatagagtgcttcgacagtgtcgagatctctggggtcgaggacaggttcaacgcatccttggggacctatcacgacctcctcaagatcattaaagacaaggacttcctcgacaacgaggagaacgaggacatactggaggacatcgtcctcaccctcactctctttgaggacagggagatgatagaggagcgcctcaaaacctacgcccacctcttcgacgacaaggtgatgaaacagctcaagaggcgcagatacaccggatggggtagactctccaggaagctgattaatggcatccgcgacaaacagtccggcaagaccatcctcgacttcctcaagagtgacggattcgccaaccgcaacttcatgcagctcatacacgacgactccctcaccttcaaggaggacatccaaaaagcccaagtctccggacagggagactcattgcacgaacacatcgccaacttggctggatctcctgctattaaaaagggcatcctccaaaccgtcaaggtggtcgacgaactcgtcaaggtcatgggtagacacaagcccgaaaatatcgtcatcgagatggcaagggagaaccagacaacccagaagggccaaaaaaactccagggagcgcatgaaacgcatcgaggagggaataaaggagctcgggtcccagatcctcaaggagcaccccgtcgaaaatactcaactccagaatgaaaagctctacctctactacctccaaaacggcagggatatgtacgtcgaccaagagctcgacattaatcgcctctccgactacgacgtcgatcacatcgtcccccagagtttcctcaaggacgactccatcgacaacaaggtcctcaccagatccgataaaaatcgcggaaagtccgacaacgtcccctctgaggaagtggttaagaagatgaaaaactactggagacagctcctcaacgcaaagctgatcacccagcgcaagttcgacaacctcacaaaggctgagagagggggactctctgagttggacaaggccggcttcatcaagagacaactcgtggaaacccgccagatcaccaagcatgtcgcacagattctcgactcccgcatgaatactaaatacgatgaaaatgacaagctcatcagggaggtcaaggtcatcaccctgaagtccaagctcgtctccgacttccgcaaggacttccagttctacaaggtccgcgagatcaacaactaccaccacgcccacgacgcatacctcaacgctgtggttggaacagcactcatcaagaagtaccccaagctcgagtccgagttcgtctacggcgactacaaggtctacgacgtcaggaagatgatcgccaagtccgagcaagagatcggaaaggccaccgcaaaatatttcttctactccaacataatgaacttcttcaaaaccgagatcaccctggctaacggagaaataaggaagaggcccctgatagaaaccaacggcgagacaggcgagattgtctgggacaaaggcagggacttcgcaaccgtcagaaaggtgctcagtatgcctcaggtcaacatagtcaaaaagaccgaagtccagactggaggattctccaaggagtccatcctccccaaaaggaactccgacaaactgatcgccaggaaaaaggactgggaccccaaaaaatatggcggcttcgactcccctactgttgcttacagtgtgctcgtcgtcgcaaaagtcgagaaggggaaatccaagaagctcaagtcagtgaaggagctcctcggcatcaccatcatggagaggtcctccttcgagaagaaccccatcgacttcctcgaggccaagggatataaggaggtcaagaaggacctcatcattaaactccccaagtactccctcttcgagctcgaaaacggacgcaagaggatgctcgcttcagctggtgaactccagaagggcaacgaactcgctttgccctctaaatacgtcaacttcctctacctcgcctcccactatgaaaagctcaagggctccccagaggacaacgagcagaagcaactcttcgtcgagcagcacaagcattacctcgacgagatcatcgagcagatctccgagttctccaagagagtcatcctcgctgacgcaaacctcgacaaggtcctcagtgcatataacaagcaccgcgacaaaccaataagggagcaggccgaaaatattatacacctgttcaccctcaccaacttgggagcaccagccgccttcaagtatttcgacaccaccatcgacagaaagcgctacacctccacaaaggaggtcctggacgccacacttatccaccagtccatcaccggcctctatgaaacacgcatcgacctctctcaattgggaggggacaagagaccaagagacagacacgatggagagcttggaggtagaaagagagcaaggtagttcgaactggccaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttggcgcgccgttaacttaacggcaaacgctaattagtcactaggcccaggaaacactaactaagccctagcttatcctagcgcaacctagttaggtcttggtaaccgcgatcgcgctgacaagcggtatttaaatcatcattctaggcgcgccacttacgcttgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccaaacgtgcaagcgctactagacaattcagtacattaaaaacgtccgcaatgtgttattaagttgtctaagcgtcaatttatttacaattgaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggcgcgcgcggtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaacgcgcgcgggcgcgccttttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatggcgcgccggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtaggaacagtgaattggagttcgtcttgttataattagcttcttgggggatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatacttcgctcgtgaaaagcagcgctcagggggctagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtacgttggaatcgcttctacaaaactcac

SEQ ID NO: 68 - DNA, 30884 bp, Artificial
  Vector 28
attatcaaaaaggatcttcacctagatccttttaaattaaaaatgaagcgtacgttggaatcgcttctacaaaactcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaacgaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacctagctaggttaccactcgagcgacttatgcttctatagggaagcggccgcgaattccagaagaccaaagggcaattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacccatggaaactcaacaacaacaagcagatattcaagattttgggaacaaaaacagtaacacctatgcatgcaggcaaagcagtactaggtggacacccacaagtgatcagatcagaatactgaaagagctctactacaacaatggaatcagatcaccaactgctgatcagattcagagaatcgctgctcaactcagacagtacggcaagattgaaggcaagaacgtgttttattggtttcagaaccataaagctcgtgaacgccagaagaaacggttcactcctactgctcctccaccaccgtctcacttctccgatcatattaaccaccatcttcccaacgctgcccccatgcagattccgtctcaccaccaccactaccaccatcaagaaccaccacatgtctatgctcaccctcacaaactctacaccactcatcacattggggttggttcttcttcacaaggagtgatgggtgtagggtgtggctatggatctgttgctatggagaagagtttcaggaagtgttcaatatcaccaccgggagagagtaaggccacaggaggaattggccggaatatcggttcaagatcacggataagtgtcgattcgtgttccttcttcgacacaattaagccaaagacatatgagatgtttgagaatcatgatcaagatgaagaacaaggagagccttcaactgagatcgaaacacttccattattcccgattcacgacggcaaccatcatgatttcttcggcatgaggacggcaaatctgcaattggagcaaggcactggaggttactacactggaggaagctggtatcggtctgatgagagggcgtctcttgagctcagtctcaactcatatggttattataactaattcgaactggccaggtacctgacatcttatagtctgcaacctctcgtgtctgaattcctatctttatcaagtgttattgcttccacgactataggacagctttcgtcgaaaggttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccaagcttggcgcgccggtcacccggtccgggcctagaaggccacccggggctcggcgttaggcttttagtccgctaggtggctagaccgaggttaggacgctagttcactaggggcctagtggtgttttaaggatgggcaagtttgtacaaaaaagcaggctggcgccggaaccaattcagtcgagtgcggccgccagtgtgatggatatctagattggaattcatagtctatgcattccatcttgaggggagggtattagattatggttaagtgatggtttaataactggtttagcttccttttactaaaccggttatataaatacatcctcttgtacattgtaaactttaacttgagcaatatactttttccttttcatcgtaacatactttccccattgatcttgagctcaagttctaataaacatattacgtaacgggtttattttgtcgtcaacacattatcggcaatgtgaaaagaaggggtgaggtatctccatttcaattcttctctttatatattaatcgaattatttacgtatgaaatgaacgtttatatagaaatttcgtgtggaaaacgacatgtacacggcatctcaagaccaattagtaatatactttagtggtgattacatgtttacttatccaattgagaatttaaagcatcgacaataccttaatgtcgattaagccgtccccacttcatgtaatgagttatggggggagagagagatcccgaaattcgtcaaataaaacaacttagaactaaaaaccgacaccaagtatcataaaggaaatgttgaagaagtcatttatcgtatccagctcacaattcctaagattaaatcatgaccgttggaagagcttataagattaaactgaagaaattgtgggttttagaagaaagacaagaaagagaagaacatgatcttacattgcctattttggtgtataggagttgtcaaaaagaggagagagaggagacaattaggtcaaataaatgagcactaaaaatggagacatgtgttgagtaactattacaagagcgacttatgcttctagatatctcgacttaaaaccttattaagtggcatgggtaacggttcaatatgatcctatcggatcaaaccgggttacatatattattgaacccggttttattggtacgatcgttaagtctcaacatctggctctaataaccgggacgatagagattgtggttagaaataaacggcgttaaaattggttgcagccgcgggcacacggatcgtgtttatcaaataaggcaattagccaaaaaatcgtttcgtgtaaaagttacgtgtcaagctttggttggttattgcttcaccgccttagctttctcgtgaccgactcgtcctcgtctttttttcttcttctataaattaataacctaagacctattcttcttcacaaattcagattccaaatttctcaaactctgaaatcgttctttcaaatctctcaatcgggatcaaggtaaatttctgggttcttattcagtttcttcgattattttccattcgatcgcaatttcgtccctgttctttgagtttgattcggttaatctttgatcggagataaatatctgagtttcatcgctagatctcatctatattctgaactagggttcgtagatttcacagatttgtatatttaggcgtcgattctttgaatttgatccgatatgtgatttatattcagatctggtggtagcttttttaatcggatttgagattatccaagcgattaatctcagttttttgtgaattacagccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattctacatatggcaatgatatcatcaccaaagtgcaatgcccctttttgccctagtttcgtaaagtctctctccttcttcgtccttaggaaaaaccctaaattaaatcctgtgttcttgatctttctttttgagtaaccatgattttgaccacacactagttcttctatattttgtggtctataggattttgctttatatgtgtttcttgtattgctccgtacgtgcgtatataaatttaaatggttacaacaaggtttattataaataggcacaaattagtccatgaagttatttagcttgcacaagtataatttgttaagtatttaaatatataaatttgttacaaaacttaattaaatttatctgattatattttctttagtgttcttcctttgccaacgttgaggtagctattattattattattttgaacattatgtacgtagttatcttggctagttatgattcgaattcttaatttggatcacacttaacagtatttaaaatattcttagaactaaaataattaagagttacctttaaattgaagtattcgtgctaaacagaaactagaataaacaaatgattgcatgttaattttttttttcgattttcctatcagaataaacacatgattgcatgcaaattttgtttttgattacgttatcttttgtttattttagttttgatgctaattaatattttttattaacaactcacatacattctacctgattctaggtcagataatgacacagcgcaacaaaattaatacaaaaccttcggaaagtagaataccgcagaagtaacttttttgggtacatacgaaatacagtgaaatctctataaattaatcgatgcggccgcctaactaactaggggtttacttattttgtgggtatctatacttttattagatttttaatcaggctcctgatttctttttatttcgattcaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatgtgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaaggttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctaggttaagtaatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgacgaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtacctagatcttgttaactgagctcttttgtgatctgatgataagtggttggttcgtgtctcatgcacttgggaggtgatctatttcacctggtgtagtttgtgtttccgtcagttggaaaaacttatccctatcgatttcgttttcattttctgcttttcttttatgtaccttcgtttgggcttgtaacgggcctttgtatttcaactctcaataataatccaagtgcatgttaaacaatttgtcatctgtttcggctttgatatactactggtgaagatgggccgtactactgcatcacaacgaaaaataataataagatgaaaaacttgaagtggaaaaaaaaaaaaacttgaatgttcactactactcattgaccataatgtttaacatacatagctcaatagtatttttgtgaatatggcaacacaaacagtccaaaacaattgtctcttactataccaaaccaagggcgccgcttgtttgccactctttgtgtgcaatagtgtgattaccacatctccacattcaatatattccctgaattatctgacgattttgatggctcactgttttcccaagtcttgaattgtcttctgtgcgccagtcaaatgcatatgtgttgagtttatcttttaaatatcaagcttttgtttttaacttttgtttgtaaccaaaaactcacagtaggagtttgatcacataattttatgtttgcctttgcaatttctagtgagtctttgattaaaagcttgaaaagaaaatgcagccaagcttaccaagtaagttatgtgtattaaccagaggaagagagaatcttgcaaaatttcaacaaacacaaaaagaagtattactacgattggtggagaaagaaaacgattccaaatcttgaactgttgttgtaaaagcatagcagaaagtgggagacaaccgaaatagaaatgactataacttaatttaatgttatcattataatttcttctagcaaatatttagaaagtaaatatcacatcaacctttaatgtaattaagctttctctttttgattcatgtgagatgaaaagaaaaaaaagaagagaaaagtgtagaaaacacatcatttctaagctgaagaagcttggcgcgccgctcgagcgacttatgcttctatagggtacccgggcttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgagcgacttatgcttctatagttttagagctagaaatagcaagttaaaataaggctagtccgttatcaacttgaaaaagtggcaccgagtcggtgcttttttttttgtctaaaaacggcccctaactaacgcttagttgcccgctagattagtcccccgttagtgcctagttagacacacgacgaactaggggctagcggccgcgtggccatctggattcagcagggggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagccatggctgcaactactcttacatctgctttacctggtgctttcagttcatcccagagaccaagtgctcctttcaacttacaaagatcacctagagtgcttagaaggttcaacagaaagacaggacgtcaacctcgtggacttgttcgtgctgcaaaggctcaagcggcgcaaaacctgccagagaaattcgatgaaacaagactctgggaggccctcaggggatttggggttagtccaagtagggttacttacgctcccgtcggattcggagattaccactggaccgtcacagatgaagacgggagaccttggttcgcaactgtcagtgacctcgaacacaaagagcattgcgggcagggagcacaagcagcccttaaaggactcagacaagctatggacactgccctcgcacttagagatagggacggactcagattcgtggttgctccagtggcagcaacagatgggggtggccctgtccttccccttgacgctaggtatgcactcacagtcttccctcacgtcccaggaagaacaggagagttcggacaaagactcacagaggcagagagggacagactgcttgctcttctggcagaactccacggaagaacacctcctgaaacaaccccaccagccgatatggaaccaccaggacttcctggtgttagagcagcactcgccgaaagtgaaggaccttggagtggaggaccatttgcagaacccgctagacttcttctcagagaacacgaggccacactgcacgcaagactcgctgaattcgaagccctcgtcgcaagagttaagggtcgtggagcacctcttgtcgttacccacggagaaccacacccaggcaacttgatcctcggagaggaaggctatctcctcgtggactgggatacagttggactggctccagctgaaagggatttgagtctcatctcagacgacccagctgacctcgcaagatacgcagagcttacaggaagaactccagacccagacgcactcgcactctatagactgcgttggagtctccttgatgtggctgagttcgtcgagtggttcagggctgaacaccaaagaacccaagacaccgagagtgcatggaaggggttcactgacacacttgggcaattggctgctggtggatcagctgcatagcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagaggtaccggcggccgctctagaaagcttagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagcggccgggatccatggcacctaaaaagaagaggaaagttatggacaaaaagtactccatagggctcgatatcggcacaaacagtgtggggtgggcagtcatcactgacgactacaaggtcccctccaagaagttcaaggtcctcggcaatacagaccgccactccatcaagaagaacctcatcggagcactgttgttcgactccggagaaactgccgaagcaaccagactcaagaggaccgccagaagaaggtacacaaggcgcaagaacaggatctgctacctccaggagatcttcagtaacgagatggcaaaggtcgacgactctttcttccacaggctcgaggaatccttcctcgtcgaggaggacaagaagcatgagagacaccccatcttcggaaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtcgcctaccacgagaagtacccaaccatctaccacctgaggaagaagctcgtcgacagtaccgacaaggctgacctcaggctcatctacctcgcactcgcccacatgattaagttcaggggccacttcctcatagagggagacctcaacccagacaactccgacgtcgacaaactcttcatccaactcgtgcagacctacaatcaactctttgaagagaacccaatcaacgcctccggagtggatgctaaggctatattgtccgccaggctctccaaatcaagacgcctcgaaaacctcatcgcccagctcccaggggagaagaaaaatagcctcttcgggaacctcatagccctgtcccttggactcacccctaacttcaaatcaaatttcgacctcgcagaggacgctaagcttcaactctccaaggacacctacgacgacgacctcgataacctcctcgcccaaatcggtgatcaatacgctgacctcttcctcgctgctaagaacctctccgacgccatactcctctccgacattctgagggtcaacaccgagatcacaaaggctcccttgtccgcctccatgattaaacgctacgacgaacaccaccaggacctcaccctcttgaaggcactggttagacagcagctccccgagaagtacaaggaaatcttcttcgaccaatcaaaaaacggctacgccggatacatcgacggaggagcatcccaggaagagttctacaagttcatcaaaccaattctcgaaaagatggacggaacagaggagctcttggtcaagctcaacagggaggacctcctcagaaagcagagaaccttcgacaacggcagtatcccccaccagatccaccttggagagttgcacgcaatcctcaggaggcaagaggacttctaccccttcctcaaggacaacagggagaagatcgagaagatccttacattccgcatcccctactacgtcggacctttggcaagaggaaactcccgcttcgcatggatgactcgcaagagtgaggaaaccatcaccccttggaacttcgaggaggtcgtcgataagggagcttcagcccagtccttcatcgagcgcatgaccaacttcgataaaaatctccccaatgaaaaagtcctccccaagcacagtctgctctacgagtacttcacagtctacaacgagctcaccaaggtcaagtacgtcaccgaaggcatgagaaaacccgccttcctcagtggcgagcagaagaaggcaatcgtggacttgctgttcaagaccaaccgcaaggtcacagtcaagcaattaaaagaggactacttcaagaaaatagagtgcttcgacagtgtcgagatctctggggtcgaggacaggttcaacgcatccttggggacctatcacgacctcctcaagatcattaaagacaaggacttcctcgacaacgaggagaacgaggacatactggaggacatcgtcctcaccctcactctctttgaggacagggagatgatagaggagcgcctcaaaacctacgcccacctcttcgacgacaaggtgatgaaacagctcaagaggcgcagatacaccggatggggtagactctccaggaagctgattaatggcatccgcgacaaacagtccggcaagaccatcctcgacttcctcaagagtgacggattcgccaaccgcaacttcatgcagctcatacacgacgactccctcaccttcaaggaggacatccaaaaagcccaagtctccggacagggagactcattgcacgaacacatcgccaacttggctggatctcctgctattaaaaagggcatcctccaaaccgtcaaggtggtcgacgaactcgtcaaggtcatgggtagacacaagcccgaaaatatcgtcatcgagatggcaagggagaaccagacaacccagaagggccaaaaaaactccagggagcgcatgaaacgcatcgaggagggaataaaggagctcgggtcccagatcctcaaggagcaccccgtcgaaaatactcaactccagaatgaaaagctctacctctactacctccaaaacggcagggatatgtacgtcgaccaagagctcgacattaatcgcctctccgactacgacgtcgatcacatcgtcccccagagtttcctcaaggacgactccatcgacaacaaggtcctcaccagatccgataaaaatcgcggaaagtccgacaacgtcccctctgaggaagtggttaagaagatgaaaaactactggagacagctcctcaacgcaaagctgatcacccagcgcaagttcgacaacctcacaaaggctgagagagggggactctctgagttggacaaggccggcttcatcaagagacaactcgtggaaacccgccagatcaccaagcatgtcgcacagattctcgactcccgcatgaatactaaatacgatgaaaatgacaagctcatcagggaggtcaaggtcatcaccctgaagtccaagctcgtctccgacttccgcaaggacttccagttctacaaggtccgcgagatcaacaactaccaccacgcccacgacgcatacctcaacgctgtggttggaacagcactcatcaagaagtaccccaagctcgagtccgagttcgtctacggcgactacaaggtctacgacgtcaggaagatgatcgccaagtccgagcaagagatcggaaaggccaccgcaaaatatttcttctactccaacataatgaacttcttcaaaaccgagatcaccctggctaacggagaaataaggaagaggcccctgatagaaaccaacggcgagacaggcgagattgtctgggacaaaggcagggacttcgcaaccgtcagaaaggtgctcagtatgcctcaggtcaacatagtcaaaaagaccgaagtccagactggaggattctccaaggagtccatcctccccaaaaggaactccgacaaactgatcgccaggaaaaaggactgggaccccaaaaaatatggcggcttcgactcccctactgttgcttacagtgtgctcgtcgtcgcaaaagtcgagaaggggaaatccaagaagctcaagtcagtgaaggagctcctcggcatcaccatcatggagaggtcctccttcgagaagaaccccatcgacttcctcgaggccaagggatataaggaggtcaagaaggacctcatcattaaactccccaagtactccctcttcgagctcgaaaacggacgcaagaggatgctcgcttcagctggtgaactccagaagggcaacgaactcgctttgccctctaaatacgtcaacttcctctacctcgcctcccactatgaaaagctcaagggctccccagaggacaacgagcagaagcaactcttcgtcgagcagcacaagcattacctcgacgagatcatcgagcagatctccgagttctccaagagagtcatcctcgctgacgcaaacctcgacaaggtcctcagtgcatataacaagcaccgcgacaaaccaataagggagcaggccgaaaatattatacacctgttcaccctcaccaacttgggagcaccagccgccttcaagtatttcgacaccaccatcgacagaaagcgctacacctccacaaaggaggtcctggacgccacacttatccaccagtccatcaccggcctctatgaaacacgcatcgacctctctcaattgggaggggacaagagaccaagagacagacacgatggagagcttggaggtagaaagagagcaaggtagttcgaactggccaggtaccgttaacctcgtctctgttatgcttaagaagttcaatgtttcgtttcatgtaaaactttggtggtttgtgttttggggccttgtataatccctgatgaataagtgttctactatgtttccgttcctgttatctctttctttctaatgacaagtcgaacttcttctttatcatcgcttcgtttttattatctgtgcttcttttgtttaatacgcctgcaaagtgactcgactctgtttagtgcagttctgcgaaacttgtaaatagtccaattgttggcctctagtaatagatgtagcgaaagtgttgagctgttgggttctaaggatggcttgaacatgttaatcttttaggttctgagtatgatgaacattcgttgttgctaagaaatgcctgtaatgtcccacaaatgtagaaaatggttcgtacctttgtccaagcattgatatgtctgatgagaggaaactgcaagatactgagcttggtttaacgaaggagaggcagtttcttccttccaaagcatttcatttgacaatgccttgatcatcttaagtagagtttctgttgtggaaagtttgaaactttgaagaaacgactctcaagtaaattgatgatcacaagtgaaagtgtatgttacataagtggatatttcaccctttttccatcaatcaaaacatcatatagtaatccattggtttatacaaacatcaaaatacatttacctctgaaatgaggaaaaaaatgcaaagagatttttgaaaatttccaacaaatggagagaaaaaaaaaaaacaaagaattaaatcaatcagtacatttataaaggttatgagacctatatgacacttattggtcaagtggcagccattccatttctagctctaattctggtaccgcccgggcctagaaggccatttagtcctagcgatcgcgctgacaagcggtatttaaatcatcattctaggcgcgccacttacgcttgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccaaacgtgcaagcgctactagacaattcagtacattaaaaacgtccgcaatgtgttattaagttgtctaagcgtcaatttatttacaattgaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggcgcgcgcggtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaacgcgcgcgggcgcgcctaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatggcgcgccggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtaggaacagtgaattggagttcgtcttgttataattagcttcttgggggatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatacttcgctcgtgaaaagcagcgctcagggggctagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgag

SEQ ID NO: 69 - DNA, 31981 bp, Artificial
  Vector 29
acgttggaatcgcttctacaaaactcacagaaacaatcaaacaaacatacacagcgatttattcacacgaacccgaattacaacggtatatatcctgtcagccaacaccaaaacatcaaaaaaatcgggatcaggatcaggatctgcggccgcatcctgcaggtttaaacggccggccttcactagctagctgctaagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaatcgagctagttaccctatgaggtgacatgaagcgctcacggttactatgacggttagcttcacgactgttggtggcagtagcgtacgacttagctatagttccggacttacctagctaggttaccactcgagcgacttatgcttctatagggaagcggccgcgaattccagaagaccaaagggcaattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacccatggaaactcaacaacaacaagcagatattcaagattttgggaacaaaaacagtaacacctatgcatgcaggcaaagcagtactaggtggacacccacaagtgatcagatcagaatactgaaagagctctactacaacaatggaatcagatcaccaactgctgatcagattcagagaatcgctgctcaactcagacagtacggcaagattgaaggcaagaacgtgttttattggtttcagaaccataaagctcgtgaacgccagaagaaacggttcactcctactgctcctccaccaccgtctcacttctccgatcatattaaccaccatcttcccaacgctgcccccatgcagattccgtctcaccaccaccactaccaccatcaagaaccaccacatgtctatgctcaccctcacaaactctacaccactcatcacattggggttggttcttcttcacaaggagtgatgggtgtagggtgtggctatggatctgttgctatggagaagagtttcaggaagtgttcaatatcaccaccgggagagagtaaggccacaggaggaattggccggaatatcggttcaagatcacggataagtgtcgattcgtgttccttcttcgacacaattaagccaaagacatatgagatgtttgagaatcatgatcaagatgaagaacaaggagagccttcaactgagatcgaaacacttccattattcccgattcacgacggcaaccatcatgatttcttcggcatgaggacggcaaatctgcaattggagcaaggcactggaggttactacactggaggaagctggtatcggtctgatgagagggcgtctcttgagctcagtctcaactcatatggttattataactaattcgaactggccaggtacctgacatcttatagtctgcaacctctcgtgtctgaattcctatctttatcaagtgttattgcttccacgactataggacagctttcgtcgaaaggttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccaagcttggcgcgccggtcacccggtccgggcctagaaggccacccggggctcggcgttaggcttttagtccgctaggtggctagaccgaggttaggacgctagttcactaggggcctagtggtgttttaaggatgggcaagtttgtacaaaaaagcaggctggcgccggaaccaattcagtcgagtgcggccgccagtgtgatggatatctagattggaattcatagtctatgcattccatcttgaggggagggtattagattatggttaagtgatggtttaataactggtttagcttccttttactaaaccggttatataaatacatcctcttgtacattgtaaactttaacttgagcaatatactttttccttttcatcgtaacatactttccccattgatcttgagctcaagttctaataaacatattacgtaacgggtttattttgtcgtcaacacattatcggcaatgtgaaaagaaggggtgaggtatctccatttcaattcttctctttatatattaatcgaattatttacgtatgaaatgaacgtttatatagaaatttcgtgtggaaaacgacatgtacacggcatctcaagaccaattagtaatatactttagtggtgattacatgtttacttatccaattgagaatttaaagcatcgacaataccttaatgtcgattaagccgtccccacttcatgtaatgagttatggggggagagagagatcccgaaattcgtcaaataaaacaacttagaactaaaaaccgacaccaagtatcataaaggaaatgttgaagaagtcatttatcgtatccagctcacaattcctaagattaaatcatgaccgttggaagagcttataagattaaactgaagaaattgtgggttttagaagaaagacaagaaagagaagaacatgatcttacattgcctattttggtgtataggagttgtcaaaaagaggagagagaggagacaattaggtcaaataaatgagcactaaaaatggagacatgtgttgagtaactattacaagagcgacttatgcttctagatatctcgacttaaaaccttattaagtggcatgggtaacggttcaatatgatcctatcggatcaaaccgggttacatatattattgaacccggttttattggtacgatcgttaagtctcaacatctggctctaataaccgggacgatagagattgtggttagaaataaacggcgttaaaattggttgcagccgcgggcacacggatcgtgtttatcaaataaggcaattagccaaaaaatcgtttcgtgtaaaagttacgtgtcaagctttggttggttattgcttcaccgccttagctttctcgtgaccgactcgtcctcgtctttttttcttcttctataaattaataacctaagacctattcttcttcacaaattcagattccaaatttctcaaactctgaaatcgttctttcaaatctctcaatcgggatcaaggtaaatttctgggttcttattcagtttcttcgattattttccattcgatcgcaatttcgtccctgttctttgagtttgattcggttaatctttgatcggagataaatatctgagtttcatcgctagatctcatctatattctgaactagggttcgtagatttcacagatttgtatatttaggcgtcgattctttgaatttgatccgatatgtgatttatattcagatctggtggtagcttttttaatcggatttgagattatccaagcgattaatctcagttttttgtgaattacagccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattctacatatggcaatgatatcatcaccaaagtgcaatgcccctttttgccctagtttcgtaaagtctctctccttcttcgtccttaggaaaaaccctaaattaaatcctgtgttcttgatctttctttttgagtaaccatgattttgaccacacactagttcttctatattttgtggtctataggattttgctttatatgtgtttcttgtattgctccgtacgtgcgtatataaatttaaatggttacaacaaggtttattataaataggcacaaattagtccatgaagttatttagcttgcacaagtataatttgttaagtatttaaatatataaatttgttacaaaacttaattaaatttatctgattatattttctttagtgttcttcctttgccaacgttgaggtagctattattattattattttgaacattatgtacgtagttatcttggctagttatgattcgaattcttaatttggatcacacttaacagtatttaaaatattcttagaactaaaataattaagagttacctttaaattgaagtattcgtgctaaacagaaactagaataaacaaatgattgcatgttaattttttttttcgattttcctatcagaataaacacatgattgcatgcaaattttgtttttgattacgttatcttttgtttattttagttttgatgctaattaatattttttattaacaactcacatacattctacctgattctaggtcagataatgacacagcgcaacaaaattaatacaaaaccttcggaaagtagaataccgcagaagtaacttttttgggtacatacgaaatacagtgaaatctctataaattaatcgatgcggccgcctaactaactaggggtttacttattttgtgggtatctatacttttattagatttttaatcaggctcctgatttctttttatttcgattcaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatgtgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaaggttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctaggttaagtaatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgacgaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtacctagatcttgttaactgagctcttttgtgatctgatgataagtggttggttcgtgtctcatgcacttgggaggtgatctatttcacctggtgtagtttgtgtttccgtcagttggaaaaacttatccctatcgatttcgttttcattttctgcttttcttttatgtaccttcgtttgggcttgtaacgggcctttgtatttcaactctcaataataatccaagtgcatgttaaacaatttgtcatctgtttcggctttgatatactactggtgaagatgggccgtactactgcatcacaacgaaaaataataataagatgaaaaacttgaagtggaaaaaaaaaaaaacttgaatgttcactactactcattgaccataatgtttaacatacatagctcaatagtatttttgtgaatatggcaacacaaacagtccaaaacaattgtctcttactataccaaaccaagggcgccgcttgtttgccactctttgtgtgcaatagtgtgattaccacatctccacattcaatatattccctgaattatctgacgattttgatggctcactgttttcccaagtcttgaattgtcttctgtgcgccagtcaaatgcatatgtgttgagtttatcttttaaatatcaagcttttgtttttaacttttgtttgtaaccaaaaactcacagtaggagtttgatcacataattttatgtttgcctttgcaatttctagtgagtctttgattaaaagcttgaaaagaaaatgcagccaagcttaccaagtaagttatgtgtattaaccagaggaagagagaatcttgcaaaatttcaacaaacacaaaaagaagtattactacgattggtggagaaagaaaacgattccaaatcttgaactgttgttgtaaaagcatagcagaaagtgggagacaaccgaaatagaaatgactataacttaatttaatgttatcattataatttcttctagcaaatatttagaaagtaaatatcacatcaacctttaatgtaattaagctttctctttttgattcatgtgagatgaaaagaaaaaaaagaagagaaaagtgtagaaaacacatcatttctaagctgaagaagcttggcgcgccgctcgagcgacttatgcttctatagggtacccgggcttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgagcgacttatgcttctatagttttagagctagaaatagcaagttaaaataaggctagtccgttatcaacttgaaaaagtggcaccgagtcggtgcttttttttttgtctaaaaacggcccctaactaacgcttagttgcccgctagattagtcccccgttagtgcctagttagacacacgacgaactaggggctagcggccgcgtggccatctggattcagcagggggtgattgcggttacatcatgtacggaaaaataattctaatccttgatttaaatttgaacttgactatttatttattctttatttcattttgtaaatcattttatgtatctcctggcaagcaattttatccaccttgcaccaacaccttcgggttccataatcaaaccaccttaacttcacaccatgctgtaactcacaccgcccagcatctccaatgtgaaagaagctaaaatttaataaacaatcatacgaagcagtgacaaaataccagatggtattaatgcttcgataaaattaattggaaagtataaaatggtagaaaataataaattataattaatttaagtaagataaaaaataattaaaaactaaaatgttaaaattttaaaaaaattattttaaataatatttaaaaacattaaaaatcattttaaaaaatttatttatagaacaattaaataaatatttcagctaataaaaaacaaaagcttacctagccttagaagacaacttgtccaacaattagatgatacccattgcccttacgttttctttaacatcaattattgtttttgtcaacaagctatcttttagttttattttattggtaaaaaatatgtcgccttcaagttgcatcatttaacacatctcgtcattagaaaaataaaactcttccctaaacgattagtagaaaaaatcattcgataataaataagaaagaaaaattagaaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaagcggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaaatgcccccacacccctcgaccctaatcgcacttcaattgcaatcaaattagttcattctctttgcgcagttccctacctctcctttcaaggttcgtagatttcttccgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagccatggctgcaactactcttacatctgctttacctggtgctttcagttcatcccagagaccaagtgctcctttcaacttacaaagatcacctagagtgcttagaaggttcaacagaaagacaggacgtcaacctcgtggacttgttcgtgctgcaaaggctcaagcggcgcaaaacctgccagagaaattcgatgaaacaagactctgggaggccctcaggggatttggggttagtccaagtagggttacttacgctcccgtcggattcggagattaccactggaccgtcacagatgaagacgggagaccttggttcgcaactgtcagtgacctcgaacacaaagagcattgcgggcagggagcacaagcagcccttaaaggactcagacaagctatggacactgccctcgcacttagagatagggacggactcagattcgtggttgctccagtggcagcaacagatgggggtggccctgtccttccccttgacgctaggtatgcactcacagtcttccctcacgtcccaggaagaacaggagagttcggacaaagactcacagaggcagagagggacagactgcttgctcttctggcagaactccacggaagaacacctcctgaaacaaccccaccagccgatatggaaccaccaggacttcctggtgttagagcagcactcgccgaaagtgaaggaccttggagtggaggaccatttgcagaacccgctagacttcttctcagagaacacgaggccacactgcacgcaagactcgctgaattcgaagccctcgtcgcaagagttaagggtcgtggagcacctcttgtcgttacccacggagaaccacacccaggcaacttgatcctcggagaggaaggctatctcctcgtggactgggatacagttggactggctccagctgaaagggatttgagtctcatctcagacgacccagctgacctcgcaagatacgcagagcttacaggaagaactccagacccagacgcactcgcactctatagactgcgttggagtctccttgatgtggctgagttcgtcgagtggttcagggctgaacaccaaagaacccaagacaccgagagtgcatggaaggggttcactgacacacttgggcaattggctgctggtggatcagctgcatagcctaggaaacttatctctgttatgaatcagaagaagttcatgtctcgtttcatttaaaactttggtggtttgtgttttggggccttgtaaagcccctgatgaataattgttcaactatgtttccgttcctgtgttatacctttctttctaatgagtaatgacatcaaacttcttctgtattgaaattatgtccttgtgagtctctttatcatcgtttcgtctttacattatatgtgctacttttgtctaatgagcctgaaaagtggctccaatggtacgcactggaagatttgttggcttctggtagatatagcgacagtgttgagcttgtaatatcatgtctcttattgctaaattagttcctttcttaacagaaaccttcaaagtttttgtttttgttttcatttacctaatgtacacatacgctggccatgactaacaacatgtccaggcttagagcatatttttttctagcttaaattgttaacttgtcattcagtaaaatccgagaattgtgaagctctaattgaagctaattcgttttataaagtcagttaaaaagtatactaaattatccaacttttcttcaaaatctcaaaattctatgacaaaacgatagtctttgtttatgtcagtaccacaaagaggtggaaaaaaacaccaaaaaaacaataagcaaactatacactgagaagaaaaataaaagagagctcaatagatgttttatactaacggtagattagatcaaagatccaagctttactctacatagagcagaacccagaatcccttcatatctcttttattctagcaccgataatctactgaaaagaagacacttagagctctgtctctttgtcaaagaagtcccagccgtcatccagaagctccttacgttcattaacagaggtaccggcggccgctctagaaagcttagatcttattagtgtttgtgcaaattcgactctacttgagttaggtagacagattcatggattgagtattaagtctagctttgattcttctagctttgtgggaagttctttagtctcgttgtattcaaagtgtggtgttcctgaaggagcttatcaagtttttaacgaggtgcctgtgaagaatctcgggatttggaacgctatgctcaaggcgtatgcgcaacattcacatactcaaaaggttattgaattgttcaaaaggatgaagctttctggaatgaaaccaaatttcataacttttttgaatgtgctcaatgctcgtagtcacgcgggtctagttgatgaagggagatactactttgatcagatgaaagaatcgaggattgagccgacggataagcattacgcttccttggtggatatgttaggacgagctggtagattacaagaagcacttgaagttatcactaatatgccgattgatcccacggaatctgtatggggagctttattaacgagttgtacagtccacaagaacacagagcttgcagcatttgcagcagacaaggtcttcgaattaggaccagtgagttccggtatgcacatttcgttatccaatgcttatgcagccgatggtagattcgaagacgcagctaaagctagaaaattgcttcgagaccgaggggaaaagaaggaaacagggctaagttgggttgaagaaaggaacaaggttcatacatttgcagctggagaaagacgtcatgagaaaagcaaggagatatatgagaagctggctgagttaggggaagagatggagaaagcgggttacattgcagacacaagctatgttctgagagaagtggatggtgacgagaagaatcaaaccataaggtatcatagtgagagattagctattgcttttggactgatcacgtttccagctgatagaccgatccgagtaatgaagaatctgcgtgtttgcggtgattgccataacgcgatcaagttcatgtccgtatgtacgagacgagtgatcattgtgagagataataatcggtttcatcggtttgaagatggcaagtgttcttgtaatgactattggtgaagaagacaaatgagagttggtttatatttaaccataatttcattcagttcacactgaaccggcgaaatttctttgccagacctattcggaattgaaacaagtggagtctcgaaacgaaaagaactttctggaattcgtttgctcacaaagctaaaaacggttgatttcatcgaaatacggcgtcgttttcaaagaacaatccagaaatcactggttttcctttatttcaaaagaagagactagaactttatttctcctctataaaatcactttgttttttcctctcttcttcataaatcaacaaaacaatcacaaatctctcgaaacgctctcgaagttccaaattttctcttagcattctctttcgtttctcgtttgcgttgaatcaaagttcgttgcgggatccatggcacctaaaaagaagaggaaagttatggacaaaaagtactccatagggctcgatatcggcacaaacagtgtggggtgggcagtcatcactgacgactacaaggtcccctccaagaagttcaaggtcctcggcaatacagaccgccactccatcaagaagaacctcatcggagcactgttgttcgactccggagaaactgccgaagcaaccagactcaagaggaccgccagaagaaggtacacaaggcgcaagaacaggatctgctacctccaggagatcttcagtaacgagatggcaaaggtcgacgactctttcttccacaggctcgaggaatccttcctcgtcgaggaggacaagaagcatgagagacaccccatcttcggaaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtcgcctaccacgagaagtacccaaccatctaccacctgaggaagaagctcgtcgacagtaccgacaaggctgacctcaggctcatctacctcgcactcgcccacatgattaagttcaggggccacttcctcatagagggagacctcaacccagacaactccgacgtcgacaaactcttcatccaactcgtgcagacctacaatcaactctttgaagagaacccaatcaacgcctccggagtggatgctaaggctatattgtccgccaggctctccaaatcaagacgcctcgaaaacctcatcgcccagctcccaggggagaagaaaaatagcctcttcgggaacctcatagccctgtcccttggactcacccctaacttcaaatcaaatttcgacctcgcagaggacgctaagcttcaactctccaaggacacctacgacgacgacctcgataacctcctcgcccaaatcggtgatcaatacgctgacctcttcctcgctgctaagaacctctccgacgccatactcctctccgacattctgagggtcaacaccgagatcacaaaggctcccttgtccgcctccatgattaaacgctacgacgaacaccaccaggacctcaccctcttgaaggcactggttagacagcagctccccgagaagtacaaggaaatcttcttcgaccaatcaaaaaacggctacgccggatacatcgacggaggagcatcccaggaagagttctacaagttcatcaaaccaattctcgaaaagatggacggaacagaggagctcttggtcaagctcaacagggaggacctcctcagaaagcagagaaccttcgacaacggcagtatcccccaccagatccaccttggagagttgcacgcaatcctcaggaggcaagaggacttctaccccttcctcaaggacaacagggagaagatcgagaagatccttacattccgcatcccctactacgtcggacctttggcaagaggaaactcccgcttcgcatggatgactcgcaagagtgaggaaaccatcaccccttggaacttcgaggaggtcgtcgataagggagcttcagcccagtccttcatcgagcgcatgaccaacttcgataaaaatctccccaatgaaaaagtcctccccaagcacagtctgctctacgagtacttcacagtctacaacgagctcaccaaggtcaagtacgtcaccgaaggcatgagaaaacccgccttcctcagtggcgagcagaagaaggcaatcgtggacttgctgttcaagaccaaccgcaaggtcacagtcaagcaattaaaagaggactacttcaagaaaatagagtgcttcgacagtgtcgagatctctggggtcgaggacaggttcaacgcatccttggggacctatcacgacctcctcaagatcattaaagacaaggacttcctcgacaacgaggagaacgaggacatactggaggacatcgtcctcaccctcactctctttgaggacagggagatgatagaggagcgcctcaaaacctacgcccacctcttcgacgacaaggtgatgaaacagctcaagaggcgcagatacaccggatggggtagactctccaggaagctgattaatggcatccgcgacaaacagtccggcaagaccatcctcgacttcctcaagagtgacggattcgccaaccgcaacttcatgcagctcatacacgacgactccctcaccttcaaggaggacatccaaaaagcccaagtctccggacagggagactcattgcacgaacacatcgccaacttggctggatctcctgctattaaaaagggcatcctccaaaccgtcaaggtggtcgacgaactcgtcaaggtcatgggtagacacaagcccgaaaatatcgtcatcgagatggcaagggagaaccagacaacccagaagggccaaaaaaactccagggagcgcatgaaacgcatcgaggagggaataaaggagctcgggtcccagatcctcaaggagcaccccgtcgaaaatactcaactccagaatgaaaagctctacctctactacctccaaaacggcagggatatgtacgtcgaccaagagctcgacattaatcgcctctccgactacgacgtcgatcacatcgtcccccagagtttcctcaaggacgactccatcgacaacaaggtcctcaccagatccgataaaaatcgcggaaagtccgacaacgtcccctctgaggaagtggttaagaagatgaaaaactactggagacagctcctcaacgcaaagctgatcacccagcgcaagttcgacaacctcacaaaggctgagagagggggactctctgagttggacaaggccggcttcatcaagagacaactcgtggaaacccgccagatcaccaagcatgtcgcacagattctcgactcccgcatgaatactaaatacgatgaaaatgacaagctcatcagggaggtcaaggtcatcaccctgaagtccaagctcgtctccgacttccgcaaggacttccagttctacaaggtccgcgagatcaacaactaccaccacgcccacgacgcatacctcaacgctgtggttggaacagcactcatcaagaagtaccccaagctcgagtccgagttcgtctacggcgactacaaggtctacgacgtcaggaagatgatcgccaagtccgagcaagagatcggaaaggccaccgcaaaatatttcttctactccaacataatgaacttcttcaaaaccgagatcaccctggctaacggagaaataaggaagaggcccctgatagaaaccaacggcgagacaggcgagattgtctgggacaaaggcagggacttcgcaaccgtcagaaaggtgctcagtatgcctcaggtcaacatagtcaaaaagaccgaagtccagactggaggattctccaaggagtccatcctccccaaaaggaactccgacaaactgatcgccaggaaaaaggactgggaccccaaaaaatatggcggcttcgactcccctactgttgcttacagtgtgctcgtcgtcgcaaaagtcgagaaggggaaatccaagaagctcaagtcagtgaaggagctcctcggcatcaccatcatggagaggtcctccttcgagaagaaccccatcgacttcctcgaggccaagggatataaggaggtcaagaaggacctcatcattaaactccccaagtactccctcttcgagctcgaaaacggacgcaagaggatgctcgcttcagctggtgaactccagaagggcaacgaactcgctttgccctctaaatacgtcaacttcctctacctcgcctcccactatgaaaagctcaagggctccccagaggacaacgagcagaagcaactcttcgtcgagcagcacaagcattacctcgacgagatcatcgagcagatctccgagttctccaagagagtcatcctcgctgacgcaaacctcgacaaggtcctcagtgcatataacaagcaccgcgacaaaccaataagggagcaggccgaaaatattatacacctgttcaccctcaccaacttgggagcaccagccgccttcaagtatttcgacaccaccatcgacagaaagcgctacacctccacaaaggaggtcctggacgccacacttatccaccagtccatcaccggcctctatgaaacacgcatcgacctctctcaattgggaggggacaagagaccaagagacagacacgatggagagcttggaggtagaaagagagcaaggtagttcgaactggccaggtaccgttaacctcgtctctgttatgcttaagaagttcaatgtttcgtttcatgtaaaactttggtggtttgtgttttggggccttgtataatccctgatgaataagtgttctactatgtttccgttcctgttatctctttctttctaatgacaagtcgaacttcttctttatcatcgcttcgtttttattatctgtgcttcttttgtttaatacgcctgcaaagtgactcgactctgtttagtgcagttctgcgaaacttgtaaatagtccaattgttggcctctagtaatagatgtagcgaaagtgttgagctgttgggttctaaggatggcttgaacatgttaatcttttaggttctgagtatgatgaacattcgttgttgctaagaaatgcctgtaatgtcccacaaatgtagaaaatggttcgtacctttgtccaagcattgatatgtctgatgagaggaaactgcaagatactgagcttggtttaacgaaggagaggcagtttcttccttccaaagcatttcatttgacaatgccttgatcatcttaagtagagtttctgttgtggaaagtttgaaactttgaagaaacgactctcaagtaaattgatgatcacaagtgaaagtgtatgttacataagtggatatttcaccctttttccatcaatcaaaacatcatatagtaatccattggtttatacaaacatcaaaatacatttacctctgaaatgaggaaaaaaatgcaaagagatttttgaaaatttccaacaaatggagagaaaaaaaaaaaacaaagaattaaatcaatcagtacatttataaaggttatgagacctatatgacacttattggtcaagtggcagccattccatttctagctctaattctggtaccgcccgggcctagaaggccatttagtcctagcgatcgcgctgacaagcggtatttaaatcatcattctaggcgcgccacttacgcttgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccaaacgtgcaagcgctactagacaattcagtacattaaaaacgtccgcaatgtgttattaagttgtctaagcgtcaatttatttacaattgaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggcgcgcgcggtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaacgcgcgcgggcgcgccttttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctcgcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggcagcgcaggccgcccagcggcaacgcatcgaggcagaagcacgccccggtgaatcgtggcaagcagccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggcaggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatggcgcgccggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtaggaacagtgaattggagttcgtcttgttataattagcttcttgggggatctttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcactttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacactccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatatcggggaagaacagtatgtcgagctattttttgacttactggggatcaagcctgattgggagaaaataaaatattatattttactggatgaattgttttagtacctagatacttcgctcgtgaaaagcagcgctcagggggctagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgt

SEQ ID NO: 70 - DNA, 45 bp, Artificial
  template sequence with SNPs
gtccatggtgcataatgagggtagtggatgatgagcaatcattgt

SEQ ID NO: 71 - DNA, 42 bp, Artificial
  Target site
catggtgcataatgagggtagtggatgatgagcaatcattgt

SEQ ID NO: 72 - DNA, 42 bp, Artificial
  target site edits
gtaccacgtattactggcatcacctactactcgttagtaaca

SEQ ID NO: 73 - DNA, 25 bp, Artificial
  WT Soy
tggtactgcaatgcgtcctttgaca

SEQ ID NO: 74 - DNA, 25 bp, Artificial
  donor DNA for gRNA2
tggtattgcaatgagatctttgaca

We claim:

1. A method for homologous recombination repair of a double-strand break at a first target site sequence in a first polynucleotide, the method comprising providing to a plant cell of a plant embryo:

(a) a first double-strand-break-inducing agent comprising a Cas endonuclease complexed to a first guide RNA, wherein the Cas endonuclease complexes with the first guide RNA within the plant cell of the plant embryo, (b) a second double-strand-break-inducing agent comprising a Cas endonuclease complexed to a second guide RNA, wherein the Cas endonuclease complexes with the second guide RNA within the plant cell of the plant embryo, (c) a second polynucleotide sequence, further comprising:

(i) a heterologous polynucleotide;

(ii) two homology regions flanking the heterologous polynucleotide, wherein one homology region comprises a sequence sharing sufficient homology with the polynucleotide sequence upstream of the first target site in the first polynucleotide and the second homology region comprises a sequence sharing sufficient homology with the polynucleotide sequence downstream of the first target site in the first polynucleotide sequence;

(iii) polynucleotide sequences encoding a ODP2 morphogenic factor protein driven by a tissue specific promoter and a WUS morphogenic factor protein driven by an inducible promoter; and, (iv) a second target site sequence that is recognized and cleaved by a second double-strand-break-inducing agent, wherein the second target site sequence is different than the first target site sequence and is adjacent to one of the homology regions of (b)(ii) but is not adjacent to the heterologous polynucleotide of (b)(i);

wherein the ODP2 and WUS morphogenic factors are expressed within the plant cell of the plant embryo;

wherein the second double-strand-break-inducing agent cleaves the second target site sequence to create a double-strand-break in the second polynucleotide sequence;

wherein the first double-strand-break-inducing agent creates a double-strand break at the first target site sequence, and wherein the second polynucleotide sequence integrates within the double-strand break at the first target site sequence via a homologous recombination repair mechanism.

2. The method of claim 1, wherein the second polynucleotide comprises two second target site sequences of (b)(iii), each of which is next to a different one of the homology regions of (b)(ii) but neither of which is next to the heterologous polynucleotide of (b)(i).

3. The method of claim 2, wherein the two target site sequences of (b)(ii) are non-identical.

4. The method of claim 1, wherein the method further comprises providing the first guide RNA to the first polynucleotide, wherein the first guide RNA selectively hybridizes with a polynucleotide sequence at or near the first target site, and wherein the first guide RNA and the Cas endonuclease form the first double-strand-break-inducing agent that nicks or cleaves the first target site.

5. The method of claim 1, wherein the second polynucleotide further comprises a selectable marker gene next to the second target site sequence but not next to either of the two homology regions.

6. The method of claim 1, wherein the heterologous polynucleotide of (c) is a donor DNA molecule that is incorporated into the target site.

7. The method of claim 1, wherein the heterologous polynucleotide of (c) is a polynucleotide modification template that comprises at least one nucleotide difference as compared to the target site sequence.

8. The method of claim 1, further comprising:
(d) identifying at least one nucleotide difference in the first polynucleotide from the homologous recombination repair of the double-strand-break at the first target site sequence, wherein the at least one nucleotide difference is selected from the group consisting of: the insertion of at least one nucleotide, the substitution of at least one nucleotide, the deletion of at least one nucleotide, the chemical modification of at least one nucleotide, and any combination of the preceding.

9. The method of claim 1, wherein the inducible promoter is a AXIG promoter.

10. The method of claim 1, wherein the tissue specific promoter is a PLTP promoter.

* * * * *